US010369206B2

(12) United States Patent
Shone et al.

(10) Patent No.: US 10,369,206 B2
(45) Date of Patent: Aug. 6, 2019

(54) CLOSTRIDIUM DIFFICILE ANTIGENS

(75) Inventors: Clifford Shone, Salisbury (GB); April Roberts, Salisbury (GB); Helen Ahern, Salisbury (GB); Michael Maynard-Smith, Salisbury (GB); John Landon, Newcastle Emlyn (GB)

(73) Assignees: THE SECRETARY OF STATE FOR HEALTH, London (GB); MICROPHARM LIMITED, Carmarthenshire (GB)

( * ) Notice: Subject to any disclaimer, the term of this patent is extended or adjusted under 35 U.S.C. 154(b) by 744 days.

(21) Appl. No.: 13/878,150

(22) PCT Filed: Oct. 5, 2011

(86) PCT No.: PCT/GB2011/051910
§ 371 (c)(1),
(2), (4) Date: Jun. 25, 2013

(87) PCT Pub. No.: WO2012/046061
PCT Pub. Date: Apr. 12, 2012

(65) Prior Publication Data
US 2013/0266583 A1 Oct. 10, 2013

(30) Foreign Application Priority Data
Oct. 5, 2010 (GB) .................................. 1016742.7

(51) Int. Cl.
*A61K 39/08* (2006.01)
*A61K 38/16* (2006.01)
*C07K 14/33* (2006.01)
*A61K 39/40* (2006.01)
*C07K 16/12* (2006.01)
*A61K 39/00* (2006.01)

(52) U.S. Cl.
CPC ............ *A61K 39/08* (2013.01); *A61K 38/164* (2013.01); *A61K 39/40* (2013.01); *C07K 14/33* (2013.01); *C07K 16/1282* (2013.01); *A61K 2039/505* (2013.01); *C07K 2317/76* (2013.01); *C07K 2319/00* (2013.01)

(58) Field of Classification Search
None
See application file for complete search history.

(56) References Cited

U.S. PATENT DOCUMENTS 5,919,463 A 7/1999 Thomas, Jr.
2007/0065466 A1 3/2007 Windle et al.

FOREIGN PATENT DOCUMENTS

| WO | 96/12802 A1 | 5/1996 |
| WO | 98/59053 A1 | 12/1998 |
| WO | 00/61762 A1 | 10/2000 |
| WO | 2007/146139 A2 | 12/2007 |
| WO | 2010/017383 A1 | 2/2010 |
| WO | 2011/067616 A1 | 6/2011 |
| WO | 2012/046061 A3 | 4/2012 |

OTHER PUBLICATIONS

Greenspan et al, (Nature Biotechnology 17:936-937, 1999).*
Harlow et al , Antibodies A Laboratory Manual, Cold Spring Harbor Laboratory Press Inc., 1988).*
Colman et al. (Research in Immunology 145: 33-36, 1994).*
Houghten et al. (New Approaches to Immunization, Vaccines 86, Cold Spring Harbor Laboratory, 1986).*
Greenspan et al. (Nature Biotechnology 7: 936-937, 1999).*
Ellis (Vaccines, W.B. Saunders Company, Chapter 29, 1988, pp. 568-574).*
Boslego et al (Vaccines and Immunotherapy, 1991, Chapter 17).*
Skolnick et al. (Trends in Biotechnology 18: 34-39, 2000).*
Belyi, I.F., and N.A. Varfolomeeva, "Construction of a Fusion Protein Carrying Antigenic Determinants of Enteric Clostridial Toxins," FEMS Microbiology Letters 225(2):325-329, Aug. 2003.
Castagliuolo, I., et al., "Clostridium difficile Toxin A Carboxyl-Terminus Peptide Lacking ADP-Ribosyltransferase Activity Acts as a Mucosal Adjuvant," Infections and Immunity 72(5):2827-2836, May 2004.
Von Eichel-Streiber, C., et al.,"Comparative Sequence Analysis of the Clostridium difficile Toxins A and B," Molecular and General Genetics 233(1-2):260-268, May 1992.
United Kindgom Intellectual Property Office, Patents Act 1977: Search Report Under Section 17, dated Feb. 4, 2011, issued in corresponding Great Britain Application No. GB 101672.7, filed Oct. 5, 2010, 5 pages.

(Continued)

*Primary Examiner* — Robert A Zeman
(74) *Attorney, Agent, or Firm* — Christensen O'Connor Johnson Kindness PLLC

(57) ABSTRACT

The present invention relates to recombinant *Clostridium difficile* antigens based on a fusion protein that consists of or comprises a first amino acid sequence and a second amino acid sequence, wherein: a) the first amino acid sequence is provided by an amino acid sequence that has at least 80% sequence identity with an amino acid sequence consisting of residues 500-1850 of a *C. difficile* Toxin A sequence or residues 1500-1851 of a *C. difficile* Toxin B sequence; and b) the second amino acid sequence is provided by an amino acid sequence that has at least 80% sequence identity with an amino acid sequence consisting of a long repeat unit located within amino acid residues 1851-2710 of a *C. difficile* Toxin A sequence or within amino acid residues 1852-2366 of a *C. difficile* Toxin B sequence; though with the proviso that the fusion protein is not a polypeptide comprising amino acid residues 543-2710 of a *C. difficile* Toxin A and with the proviso that the f

(56) References Cited

OTHER PUBLICATIONS

European Patent Office Written Opinion dated Feb. 15, 2013, issued in corresponding International Patent Application No. PCT/GB2011/051910, 7 pages.
Written Opinion of the International Searching Authority dated Apr. 5, 2013, issued in corresponding International Patent Application No. PCT/GB2011/051910, 6 pages.
Response to the Written Opinion of the International Searching Authority issued in corresponding International Patent Application No. PCT/GB2011/051910, dated Apr. 15, 2013, 9 pages.
International Preliminary Report on Patentabilily dated May 14, 2013, issued in corresponding International Patent Application No. PCT/GB2011/051910, 8 pages.
Ho, J.G.S., et al., "Crystal Structure of Receptor-Binding C-Terminal Repeats From Clostridium difficile Toxin A," Proceedings of the National Academy of Sciences of the USA (PNAS) 102(51):18373-18378, Dec. 2005.
Pruitt, R.N., et al., "Structural Determinants of Clostridium difficile Toxin A Glucosyltransferase Activity," Journal of Biological Chemistry 287(11):8013-8020, Mar. 2012.
Pruitt, R.N., et al., "Structural Organization of the Functional Domains of Clostridium difficile Toxins A and B," Proceedings of the National Academy of Sciences of the USA (PNAS) 107(30):13467-13472, Jul. 2010.
Reinert, D.J., et al., "Structural Basis for the Function of Clostridium difficile Toxin B," Journal of Molecular Biology 351(5):973-981, Sep. 2005.

* cited by examiner

Figure 1

Toxin A

| Effector | Protease | | Translocation | | Receptor binding |

1　　　　542　　770　　　　1130　　　　1850　　　　　　　2710

Toxin B

| Effector | Protease | | Translocation | | Receptor binding |

1　　　　543　　767　　　　1128　　　　1852　　　　2366

CLOSTRIDIUM DIFFICILE ANTIGENS

The present invention relates to antigens for the prevention/treatment/suppression of *Clostridium difficile* infection (CDI). Also provided are methods for generating said antigens, methods for generating antibodies that bind to said antigens, and the use of said antibodies for the prevention/treatment/suppression of CDI.

*Clostridium difficile* infection (CDI) is now a major problem in hospitals worldwide. The bacterium causes nosocomial, antibiotic-associated disease which manifests itself in several forms ranging from mild self-limiting diarrhoea to potentially life-threatening, severe colitis. Elderly patients are most at risk from these potentially life-threatening diseases and incidents of CDI have increased dramatically over the last 10 years. In 2010 in the UK there were over 21,000 cases of CDI with over 2,700 associated deaths. CDI costs the UK National Health Service in excess of £500M per annum.

The various strains of *C. difficile* may be classified by a number of methods. One of the most commonly used is polymerase chain reaction (PCR) ribotyping in which PCR is used to amplify the 16S-23S rRNA gene intergenic spacer region of *C. difficile*. Reaction products from this provide characteristic band patterns identifying the bacterial ribotype of isolates. Toxinotyping is another typing method in which the restriction patterns derived from DNA coding for the *C. difficile* toxins are used to identify strain toxinotype. The differences in restriction patterns observed between toxin genes of different strains are also indicative of sequence variation within the *C. difficile* toxin family. For example, there is an approximate 13% sequence difference with the C-terminal 60 kDa region of toxinotype 0 Toxin B compared to the same region in toxinotype III Toxin B.

Strains of *C. difficile* produce a variety of virulence factors, notable among which are several protein toxins: Toxin A, Toxin B and, in some strains, a binary toxin which is similar to *Clostridium perfringens* iota toxin. Toxin A is a large protein cytotoxin/enterotoxin which plays a role in the pathology of infection and may influence the gut colonisation process. Outbreaks of CDI have been reported with Toxin A-negative/Toxin B-positive strains, which indicates that Toxin B is also capable of playing a key role in the disease pathology.

The genetic sequences encoding Toxin A and Toxin B (Mw 308 k and Mw 269 k, respectively) are known—see, for example, Moncrief et al. (1997) Infect. Immun 63: 1105-1108. The two toxins have high sequence homology and are believed to have arisen from gene duplication. The toxins also share a common structure (see FIG. 1), namely an N-terminal glucosyl transferase domain, a central hydrophobic region, four conserved cysteines, and a long series of C-terminal repeating units (RUs).

Toxin A comprises 39 contiguous repeating units (RUs), which span amino acid residues 1851-2710 of the Toxin A polypeptide sequence. Toxin B comprises fewer RUs (between 19 and 24) which span amino acid residues 1852-2366 of the Toxin B polypeptide sequence. For both Toxins A and B, the repeating units are of two different types: short repeats (SRs) of approximately 15-25 residues and long repeats (LRs) of approximately 30 residues. The LRs are separated from each other by 3 or 4 SRs, and the LRs together with the flanking SRs provide the binding sites for the carbohydrate receptor of the toxins. Toxin A has 7 LRs within its C-terminal domain, which are believed to provide 7 receptor binding sites (Greco et al. (2005) Nature Structural Biol. 13: 460-461). Toxin B has 4 LRs, which are believed to provide 4 carbohydrate binding units. Examples of the Toxin A and Toxin B SR/LR clusters (also known as receptor-binding "Modules") vary in size from 92-141 amino acid residues, and are exemplified by reference to Tables 1 and 2.

Both Toxins A and B exert their mechanisms of action via multi-step mechanisms, which include binding to receptors on the cell surface, internalisation followed by translocation and release of the effector domain into the cell cytosol, and finally intracellular action. Said mechanism of action involves the inactivation of small GTPases of the Rho family. In this regard, the toxins catalyse the transfer of a glucose moiety (from UDP-glucose) onto an amino residue of the Rho protein. Toxins A and B also contain a second enzyme activity in the form of a cysteine protease, which appears to play a role in the release of the effector domain into the cytosol after translocation. The *C. difficile* binary toxin modifies cell actin by a mechanism which involves the transfer of an ADP-ribose moiety from NAD onto its target protein.

Current therapies for the treatment of *C. difficile* infection rely on the use of antibiotics, notably metronidazole and vancomycin. However, these antibiotics are not effective in all cases and 20-30% of patients suffer relapse of the disease. Of major concern is the appearance in the UK of more virulent strains, which were first identified in Canada in 2002. These strains, which include those belonging to PCR ribotype 027 and toxinotype III, cause CDI with a directly attributable mortality more than 3-fold that observed previously.

New therapeutics are therefore required especially urgently since the efficacy of current antibiotics appears to be decreasing.

An attractive alternative is the use of antibodies which bind to and neutralise the activity of Toxin A and Toxin B. This is based on the knowledge that strains of *C. difficile* that do not release these toxins, so called non-toxigenic strains, do not cause CDI. In one approach patients with CDI or subjects at risk of developing such infections can be immunised with antigens which result in an increase in circulating and mucosal antibodies directed against Toxin A and Toxin B. This is defined as active immunisation. Alternatively, animals, such as horses or sheep, can be immunised, their sera collected and the antibodies purified for administration to patients—passive immunisation.

A critical requirement for both active and passive immunisation is the availability of suitable antigens with which to immunise the patient or animal respectively. These can comprise the natural toxins which can be purified from the media in which suitable toxigenic strains of *C. difficile* have been cultured. There are several disadvantages to this approach. Both Toxin A and Toxin B are present in culture medium in only small amounts and are difficult to purify without incurring significant losses. Thus, it will be both costly and difficult to obtain the amounts necessary to meet world-wide needs. In addition, the natural toxins are unstable and, because of their toxicity, must be converted to their toxoids (inactivated toxins) prior to their use as immunogens.

The above mentioned problems have resulted in there being few available *C. difficile* vaccine candidates. To-date, the only CDI vaccine in late-stage development is based on a mixture of native (i.e. naturally occurring) Toxins A and B, which have been inactivated by chemical modification (Salnikova et al. (2008), J. Pharm. Sci., 97: 3735-3752).

One alternative to the use of natural toxins and their toxoids, involves the design, development and use of recombinant fragments derived from Toxins A and B. Among their advantages are that such fragments can be expressed and purified in large amounts and at lower cost than the native toxins. Examples of existing antigens intended for use in treating/preventing a *C. difficile* infection include peptides based on the C-terminal repeating units (RUs) of Toxin A or Toxin B—see, for example, WO00/61762. A problem with such antigens, however, is that they are either poorly immunogenic (i.e. the antigens produce poor antibody titres), or, where higher antibody titres are produced, the antibodies demonstrate poor neutralising efficacy against *C. difficile* cytotoxic activity (i.e. insufficient neutralising antibodies are produced).

There is therefore a need in the art for new vaccines/therapies/therapeutics capable of specifically addressing *C. difficile* infection (CD). This need is addressed by the present invention, which solves one or more of the above-mentioned problems.

In one embodiment, the present invention provides antigens that are able to induce a potent toxin-neutralising response against *C. difficile* Toxin A and/or B. The invention also provides methods for preparing recombinant antigens. In another embodiment, said antigens are used as immunogens to enable the large-scale preparation of therapeutic antibodies. In a further embodiment, said antibodies are able to induce a potent toxin-neutralising response against *C. difficile* Toxin A and/or B and therefore have prophylactic and/or therapeutic applications.

As mentioned above (see WO 00/61762), previous studies describe vaccine preparations based on the C-terminal, repeating units (RUs) of Toxin A and/or Toxin B. Said RU fragments have a poor toxin-neutralising effect, and/or are difficult to manufacture in large quantities.

In contrast, the present invention provides a *C. difficile* antigen based on a Toxin A and/or a Toxin B repeat unit, and further includes an additional *C. difficile* toxin domain, which the present inventors believe provides an important 'scaffold' function to the antigen. Said antigens of the invention demonstrate good toxin-neutralising immune responses and/or are readily manufactured in large quantities.

The present inventors have surprisingly identified that the presence of a "scaffold" first amino acid sequence (as above) provides a protective (toxin-neutralising) immune response that is between 10-100 fold increased as compared to corresponding fragments comprising just the repeat regions of Toxin A or Toxin B. Tables 3-10 clearly show the superior capacity of fusion proteins of the present invention to elicit a toxin-neutralising immune response compared to fragments containing just the repeat domains of a *C. difficile* Toxin. Comparison of the data in Tables 5 and 6 confirms that the Toxin B-based constructs of the present invention elicit a considerably more potent toxin-neutralising immune response than that of a corresponding construct based solely on the C-terminal repeating units of Toxin B (designated TxB2). In more detail, after an 18-week immunisation period, the toxin-neutralising immune response provided by constructs of the present invention was approximately 128-fold higher than that provided by the TxB2 construct. Tables 9 and 10 show similar data for Toxin A-based constructs of the present invention. Comparison of the data in said Tables confirms that the Toxin A-based constructs of the present invention elicit a considerably more potent toxin-neutralising immune response than that of a corresponding construct based solely on the C-terminal repeating units of Toxin A (designated TxA2). In more detail, after an 18-week immunisation period, the toxin-neutralising immune response provided by constructs of the present invention was 12-fold higher than that provided by the TxA2 construct.

These findings are surprising for a number of reasons. Previous studies have shown that toxin fragments consisting of the *C. difficile* Toxin RUs fold correctly, readily crystallise to yield an ordered structure (Ho et al. (2005) *Proc. Natl. Acad. Sci. USA*, 102: 18373-18378), and bind carbohydrate moieties that mimic the natural *C. difficile* Toxin receptors (Greco et al. (2006) Nature Structure & Molecular Biology, 13: 460-461). Thus, the scientific evidence to-date supports and is consistent with the prior art use (e.g. WO 00/61762) of fragments consisting of the *C. difficile* Toxin RUs in antigenic formulations. More importantly, however, a further study has confirmed that antibodies raised against a whole *C. difficile*, while recognising a fragment consisting of the entire RU region alone, failed to recognise a fragment consisting of a "scaffold" region based on residues 901-1750 of the *C. difficile* same toxin (Genth et al., (2000) Infect. Immun., 68: 1094-1101). These data therefore suggest that domains within "scaffold" residues 901-1750 contribute no significant antibody-binding structural determinants. In this regard, other than at the peptide bond, there is no contact in the tertiary structure between "scaffold" toxin domains and the C-terminal repeat region residues—see Pruitt et al., (2010) *Proc. Natl. Acad. Sci. USA,* 1002199107 online publication. Collectively, it is therefore extremely surprising that the inclusion of a *C. difficile* "scaffold" region within recombinant immunogens of Toxins A and/or Toxin B has the effect of significantly enhancing the toxin-neutralising immune response.

A first aspect of the present invention provides a fusion protein, consisting of or comprising a first amino acid sequence and a second amino acid sequence, wherein:

1) the first amino acid sequence is provided by an amino acid sequence that has at least 80% sequence identity with an amino acid sequence consisting of residues 1500-1850 of a *C. difficile* Toxin A sequence; and 2) the second amino acid sequence is provided by an amino acid sequence that has at least 80% sequence identity with an amino acid sequence consisting of a long repeat unit located within amino acid residues 1851-2710 of a *C. difficile* Toxin A sequence; with the proviso that the fusion protein is not a polypeptide comprising amino acid residues 543-2710 of a *C. difficile* Toxin A.

Reference to a *C. difficile* Toxin A sequence means the amino acid sequence of a naturally-occurring *C. difficile* Toxin A (also referred to as a *C. difficile* Toxin A reference sequence). Examples of such sequences are readily understood by a skilled person, and some of the more common naturally-occurring Toxin A sequences are identified in the present specification (see, for example, SEQ ID NOs: 1 & 3) as well as throughout the literature.

Reference to 'at least 80% sequence identity' throughout this specification is considered synonymous with the phrase 'based on' and may embrace one or more of at least 85%, at least 90%, at least 93%, at least 95%, at least 97%, at least 99%, and 100% sequence identity. When assessing sequence identity, a reference sequence having a defined number of contiguous amino acid residues is aligned with an amino acid sequence (having the same number of contiguous amino acid residues) from the corresponding portion of a fusion protein of the present invention.

In one embodiment, the first amino acid sequence is based on (ie. has at least 80% sequence identity with) amino acid residues 544-1850 of a *C. difficile* Toxin A. In another embodiment, the first amino acid sequence is based on an N-terminal truncation of amino acid residues 544-1850 of a C. difficile Toxin A, such as amino acid residues 564-1850, amino acid residues 584-1850, amino acid residues 594-1850, amino acid residues 614-1850, amino acid residues 634-1850, amino acid residues 654-1850, amino acid residues 674-1850, amino acid residues 694-1850, amino acid residues 714-1850, amino acid residues 734-1850, amino acid residues 754-1850, amino acid residues 767-1850, amino acid residues 770-1850, amino acid residues 774-1850, amino acid residues 794-1850, amino acid residues 814-1850, amino acid residues 834-1850, amino acid residues 854-1850, amino acid residues 874-1850, amino acid residues 894-1850, amino acid residues 914-1850, amino acid residues 934-1850, amino acid residues 954-1850, amino acid residues 974-1850, amino acid residues 994-1850, amino acid residues 1014-1850, amino acid residues 1034-1850, amino acid residues 1054-1850, amino acid residues 1074-1850, amino acid residues 1094-1850, amino acid residues 1104-1850, amino acid residues 1124-1850, amino acid residues, amino acid residues 1131-1850, amino acid residues 1144-1850, amino acid residues 1164-1850, amino acid residues 1184-1850, amino acid residues 1204-1850, amino acid residues 1224-1850, amino acid residues 1244-1850, amino acid residues 1264-1850, amino acid residues 1284-1850, amino acid residues 1304-1850, amino acid residues 1324-1850, amino acid residues 1344-1850, amino acid residues 1364-1850, amino acid residues 1384-1850, amino acid residues 1404-1850, amino acid residues 1424-1850, amino acid residues 1444-1850, amino acid residues 1464-1850, or amino acid residues 1684-1850 of a C. difficile Toxin A; though always with the proviso that the fusion protein is not a polypeptide comprising amino acid residues 543-2710 of a C. difficile Toxin A. By way of example only, the above amino acid position numbering may refer to the C. difficile Toxin A sequences identified as SEQ ID NOs: 1 and/or 3.

In one embodiment, the second amino acid sequence is based on (ie. has at least 80% sequence identity with) any one or more of the long repeat (LR) amino acid sequences from a C. difficile Toxin A sequence. By way of example only, said one or more LR sequences may be based on any of SEQ ID NOs: 60, 62, 64, 66, 68, 70 and/or 72. In another embodiment, the second amino acid sequence is based on an entire Module sequence of a C. difficile Toxin A sequence, which includes a LR amino acid sequence plus one or more of its (flanking) short repeat (SR) sequences. By way of example only, the second amino acid may be based on one or more of SEQ ID NOs: 61, 63, 65, 67, 69, 71 and/or 73. In another embodiment, the second amino acid sequence is based on a sequence consisting of or comprising the entire Module 1 amino acid sequence from a C. difficile Toxin A sequence (residues 1851-2007)—see, for example, the Module 1 as illustrated in Table 1. In another embodiment, the second amino acid sequence is based on a sequence consisting of or comprising the entire Module 1 plus Module 2 amino acid sequence from a C. difficile Toxin A sequence (eg. residues 1851-2141 as illustrated in Table 1). In another embodiment, the second amino acid sequence is based on a sequence consisting of or comprising the entire Module 1 plus Module 2 plus Module 3 amino acid sequence from a C. difficile Toxin A sequence (eg. residues 1851-2253 as illustrated in Table 1). In another embodiment, the second amino acid sequence is based on a sequence consisting of or comprising the entire Module 1 plus Module 2 plus Module 3 plus Module 4 amino acid sequence from a C. difficile Toxin A sequence (eg. residues 1851-2389 as illustrated in Table 1). In another embodiment, the second amino acid sequence is based on a sequence consisting of or comprising the entire Module 1 plus Module 2 plus Module 3 plus Module 4 plus Module 5 amino acid sequence from a C. difficile Toxin A sequence (eg. residues 1851-2502 as illustrated in Table 1). In another embodiment, the second amino acid sequence is based on a sequence consisting of or comprising the entire Module 1 plus Module 2 plus Module 3 plus Module 4 plus Module 5 plus Module 6 amino acid sequence from a C. difficile Toxin A sequence (eg. residues 1851-2594 as illustrated in Table 1). In another embodiment, the second amino acid sequence is based on a sequence consisting of or comprising the entire Module 1 plus Module 2 plus Module 3 plus Module 4 plus Module 5 plus Module 6 plus Module 7 amino acid sequence from a C. difficile Toxin A sequence (eg. residues 1851-2710 as illustrated in Table 1). By way of example only, the above amino acid position numbering may refer to the C. difficile Toxin A sequences identified as SEQ ID NOs: 1 and/or 3.

Any of the embodiments for the second amino acid sequence may be combined with any of the embodiments described for the first amino acid sequence.

In one embodiment a fusion protein is provided, which comprises or consists of a sequence based on amino acid residues 1851-2710 of a Toxin A sequence (or a portion thereof) and an N-terminal polypeptide based on amino acid residues 770-1850 of a Toxin A polypeptide (or a portion thereof).

In another embodiment a fusion protein is provided, which comprises or consists of a sequence based on amino acid residues 1851-2710 of a Toxin A sequence (or a portion thereof) and an N-terminal polypeptide based on amino acid residues 1131-1850 of a Toxin A polypeptide.

In another embodiment a fusion protein is provided, which comprises or consists of a sequence based on amino acid residues 770-2710 or 1131-2710 of a Toxin A polypeptide (e.g. SEQ ID NOs 5, 6, 7, 8, 18, 19, 20, 21, 22, 28, 29, 30, 31, 32, 33, 34, 35, 36, 37, 38, 39, 40, 41, 42, 43, or 58).

In another embodiment a fusion protein is provided, which comprises or consists of a sequence based on amino acid residues 770-2007, 770-2141, 770-2253, 770-2389 or 1131-2007, 1131-2141, 1131-2253 or 1131-2389 of a Toxin A polypeptide (e.g. SEQ ID NO 59).

A related first aspect of the present invention provides a fusion protein, consisting of or comprising a first amino acid sequence and a second amino acid sequence, wherein:
1) the first amino acid sequence is provided by an amino acid sequence that has at least 80% sequence identity with an amino acid sequence consisting of residues 1500-1851 of a C. difficile Toxin B sequence; and
2) the second amino acid sequence is provided by an amino acid sequence that has at least 80% sequence identity with an amino acid sequence consisting of a long repeat unit located within amino acid residues 1852-2366 of a C. difficile Toxin B sequence; with the proviso that the fusion protein is not a polypeptide comprising amino acid residues 543-2366 of a C. difficile Toxin B.

Reference to a C. difficile Toxin B sequence means the amino acid sequence of a naturally-occurring C. difficile Toxin B (also referred to as a C. difficile Toxin B reference sequence). Examples of such sequences are readily understood by a skilled person, and some of the more common naturally-occurring Toxin B sequences are identified in the present specification (see, for example, SEQ ID NOs: 2 & 4) as well as throughout the literature.

In one embodiment, the first amino acid sequence is based on (ie. has at least 80% sequence identity with) amino acid residues 544-1851 of a C. difficile Toxin B. In another embodiment, the first amino acid sequence is based on an N-terminal truncation of amino acid residues 544-1851 of a *C. difficile* Toxin B, such as amino acid residues 564-1851, amino acid residues 584-1851, amino acid residues 594-1851, amino acid residues 614-1851, amino acid residues 634-1851, amino acid residues 654-1851, amino acid residues 674-1851, amino acid residues 694-1851, amino acid residues 714-1851, amino acid residues 734-1851, amino acid residues 754-1851, amino acid residues 767-1851, amino acid residues 770-1851, amino acid residues 774-1851, amino acid residues 794-1851, amino acid residues 814-1851, amino acid residues 834-1851, amino acid residues 854-1851, amino acid residues 874-1851, amino acid residues 894-1851, amino acid residues 914-1851, amino acid residues 934-1851, amino acid residues 954-1851, amino acid residues 974-1851, amino acid residues 994-1851, amino acid residues 1014-1851, amino acid residues 1034-1851, amino acid residues 1054-1851, amino acid residues 1074-1851, amino acid residues 1094-1851, amino acid residues 1104-1851, amino acid residues 1124-1851, amino acid residues 1131-1851, amino acid residues 1144-1851, amino acid residues 1164-1851, amino acid residues 1184-1851, amino acid residues 1204-1851, amino acid residues 1224-1851, amino acid residues 1244-1851, amino acid residues 1264-1851, amino acid residues 1284-1851, amino acid residues 1304-1851, amino acid residues 1324-1851, amino acid residues 1344-1851, amino acid residues 1364-1851, amino acid residues 1384-1851, amino acid residues 1404-1851, amino acid residues 1424-1851, amino acid residues 1444-1851, amino acid residues 1464-1851, or amino acid residues 1684-1851 of a *C. difficile* Toxin B; though always with the proviso that the fusion protein is not a polypeptide comprising amino acid residues 543-2366 of a *C. difficile* Toxin B. By way of example only, the above amino acid position numbering may refer to the *C. difficile* Toxin B sequences identified as SEQ ID NOs: 2 and/or 4.

In one embodiment, the second amino acid sequence is based on (ie. has at least 80% sequence identity with) any one or more of the long repeat (LR) amino acid sequences from a *C. difficile* Toxin B sequence. By way of example only, said one or more LR sequences may be based on any of SEQ ID NOs: 74, 76, 78 and/or 80. In another embodiment, the second amino acid sequence is based on an entire Module sequence of a *C. difficile* Toxin B sequence, which includes a LR amino acid sequence plus one or more of its (flanking) short repeat (SR) sequences. By way of example only, the second amino acid sequence may be based on one or more of SEQ ID NOs: 75, 77, 79 and/or 81. In another embodiment the second amino acid is based on a sequence consisting of or comprising the entire Module 1 amino acid sequence from a *C. difficile* Toxin B sequence (residues 1852-2007)—see, for example, the Module 1 as illustrated in Table 2. In another embodiment, the second amino acid sequence is based on a sequence consisting of or comprising the entire Module 1 plus Module 2 amino acid sequence from a *C. difficile* Toxin B sequence (eg. residues 1852-2139 as illustrated in Table 2). In another embodiment, the second amino acid sequence is based on a sequence consisting of or comprising the entire Module 1 plus Module 2 plus Module 3 amino acid sequence from a *C. difficile* Toxin B sequence (eg. residues 1851-2273 as illustrated in Table 2). In another embodiment, the second amino acid sequence is based on a sequence consisting of or comprising the entire Module 1 plus Module 2 plus Module 3 plus Module 4 amino acid sequence from a *C. difficile* Toxin B sequence (eg. residues 1851-2366 as illustrated in Table 2). By way of example only, the above amino acid position numbering may refer to the *C. difficile* Toxin B sequences identified as SEQ ID NOs: 2 and/or 4.

Any of the embodiments for the second amino acid sequence may be combined with any of the embodiments described for the first amino acid sequence.

In one embodiment, when the first and second amino acid sequences are both based on Toxin B sequences, the fusion protein may consist of or comprise an amino acid sequence that is based on at least 871 or at least 876 or at least 881 or at least 886 or at least 891 or at least 896 or at least 901 contiguous amino acid residues (e.g. starting from the C-terminal amino acid residue) of a *C. difficile* Toxin B sequence, such as SEQ ID NOs: 2 and/or 4).

In one embodiment a fusion protein is provided, which comprises or consists of a sequence based on amino acid residues 1852-2366 of a Toxin B polypeptide (or a portion thereof) and an N-terminal polypeptide based on amino acid residues 767-1851 of a Toxin B polypeptide (or a portion thereof).

In another embodiment a fusion protein is provided, which comprises or consists of a sequence based on amino acid residues 1852-2366 of a Toxin B polypeptide (or a portion thereof) and an N-terminal polypeptide based on amino acid residues 1145-1851 of a Toxin B polypeptide (or a portion thereof).

In another embodiment a fusion protein is provided, which comprises or consists of a sequence based on amino acid residues 767-2366 or 957-2366 or 1138-2366 of a Toxin B polypeptide (e.g. SEQ ID NOs 9, 10, 11, 12, 13, 14, 23, 24, 25, 26, 27, 44, 45, 46, 47, 48, 49, 50, 51, 52, 53, 54, 55, 56 or 57).

The present invention also provides fusion proteins that are chimeras of Toxin A and B domains. For example, one or more long repeat unit (optionally including one or more short repeat unit; or one, more or all Modules) based on a Toxin B polypeptide may be combined with a "scaffold" region of a Toxin A polypeptide. Similarly, one or more long repeat unit (optionally including one or more short repeat unit; or one, more or all Modules) based on a Toxin A polypeptide may be combined with a "scaffold" region of a Toxin B polypeptide.

Thus, a further related aspect of the present invention provides a hybrid/chimera fusion protein, consisting of or comprising a first amino acid sequence and a second amino acid sequence, wherein:
1) the first amino acid sequence is provided by an amino acid sequence that has at least 80% sequence identity with an amino acid sequence consisting of residues 1500-1850 of a *C. difficile* Toxin A sequence; and
2) the second amino acid sequence is provided by an amino acid sequence that has at least 80% sequence identity with an amino acid sequence consisting of a long repeat unit located within amino acid residues 1852-2366 of a *C. difficile* Toxin B sequence;
with the proviso that the fusion protein is not a polypeptide comprising amino acid residues 543-2710 of a *C. difficile* Toxin A;
and with the proviso that the fusion protein is not a polypeptide comprising amino acid residues 543-2366 of a *C. difficile* Toxin B.

Embodiments of the first and second amino acid sequences are as detailed above.

For example, in one embodiment a fusion protein is provided, which comprises or consists of a sequence based on amino acid residues 1852-2366 of a Toxin B polypeptide (or a portion thereof) and an N-terminal polypeptide based on amino acid residues 770-1849 of a Toxin A polypeptide (or a portion thereof).

In another embodiment a fusion protein is provided, which comprises or consists of a sequence based on amino acid residues 1852-2366 of a Toxin B polypeptide (or a portion thereof) and an N-terminal polypeptide based on amino acid residues 1131-1849 of a Toxin A polypeptide (or a portion thereof).

In another embodiment, a fusion protein is provided, which comprises or consists of a sequence based on amino acid residues 1852-2366 of a Toxin B polypeptide (or a portion thereof) and an N-terminal polypeptide based on amino acid residues 1500-1849 of a Toxin A polypeptide (or a portion thereof). In one embodiment, said Toxin A polypeptide component is preferably based on a sequence that is shorter than residues 543-1849 of a Toxin A polypeptide.

Specific examples include fusion proteins consisting of or comprising an amino acid sequence based on any one or more of SEQ ID NOs: 16 or 17.

Similarly, a further related first aspect of the present invention provides a hybrid/chimera fusion protein, consisting of or comprising a first amino acid sequence and a second amino acid sequence, wherein:
1) the first amino acid sequence is provided by an amino acid sequence that has at least 80% sequence identity with an amino acid sequence consisting of residues 1500-1851 of a *C. difficile* Toxin B sequence; and
2) the second amino acid sequence is provided by an amino acid sequence that has at least 80% sequence identity with an amino acid sequence consisting of a long repeat unit located within amino acid residues 1851-2710 of a *C. difficile* Toxin A sequence; with the proviso that the fusion protein is not a polypeptide comprising amino acid residues 543-2710 of a *C. difficile* Toxin A and with the proviso that the fusion protein is not a polypeptide comprising amino acid residues 543-2366 of a *C. difficile* Toxin B.

Embodiments of the first and second amino acid sequences are as detailed above.

In one embodiment a fusion protein is provided, which comprises or consists of a sequence based on amino acid residues 1850-2710 of a Toxin A polypeptide (or a portion thereof) and an N-terminal polypeptide based on amino acid residues 767-1851 of a Toxin B polypeptide (or a portion thereof).

In another embodiment a fusion protein is provided, which comprises or consists of a sequence based on amino acid residues 1850-2710 of a Toxin A polypeptide (or a portion thereof) and an N-terminal polypeptide based on amino acid residues 1145-1851 of a Toxin B polypeptide (or a portion thereof).

In another embodiment, a fusion protein is provided, which comprises or consists of a sequence based on amino acid residues 1850-2710 of a Toxin A polypeptide (or a portion thereof) and an N-terminal polypeptide based on 1500-1851 of a Toxin B polypeptide. In one embodiment, the Toxin B polypeptide component is preferably based on a sequence that is shorter than residues 543-1851 of a Toxin B polypeptide.

Specific examples include fusion proteins consisting of or comprising an amino acid sequence based on SEQ ID NO: 15.

As hereinbefore described, the present invention relates to fusion proteins based on a "scaffold" section plus a LR portion (of the C-terminal repeating units) of a *C. difficile* Toxin A and/or a *C. difficile* Toxin B. In this regard, the total portion(s) of said fusion proteins that is based on said *C. difficile* Toxin A and/or Toxin B sequences typically amounts to a maximum of 1940 contiguous amino acid residues (for example a maximum of 1890, or 1840, or 1790, or 1740, or 1690, or 1640, or 1590, or 1540, or 1490, 1440, or 1390, or 1340, or 1290, or 1240 contiguous amino acid residues).

In one embodiment, the fusion protein substantially lacks cysteine protease activity. In another (or the same) embodiment, the fusion protein substantially lacks glucosyl transferase activity. For example, part or all of the amino acid sequence(s) providing said activity (activities) are typically absent (e.g. deleted) from the fusion proteins of the present invention. These enzymatic activities are present in native Toxin A and/or Toxin B, and are associated with N-terminal domains of said Toxins (see FIG. 1).

In another embodiment, the fusion protein substantially lacks the glucosyl transferase domain (amino acid residues 1-542 Toxin A; amino acid residues 1-543 Toxin B) of a native *C. difficile* Toxin. In another (or the same) embodiment, the fusion protein substantially lacks the cysteine protease domain (amino acid residues 543-770 Toxin A; 544-767 Toxin B) of a native *C. difficile* Toxin. Said amino acid residue numbering refers to any Toxin A or Toxin B toxinotype, for example any one or more of the reference Toxin A and/or Toxin B toxinotype SEQ ID NOs recited in the present specification. Accordingly, said amino acid residue numbering may refer to any specific Toxin A and/or Toxin B reference SEQ ID NO recited in the present specification including an amino acid sequence variant having at least 80%, at least 85%, at least 90%, at least 93%, at least 95%, at least 97%, or at least 99% thereto.

Fusion protein constructs of the invention may be derived from any Toxin A and/or B sequence (including any toxinotype sequence), such as those illustrated in the present specification. For example, in one embodiment, first and/or second amino acid sequences are derived from Toxins A and/or B of toxinotype 0 (SEQ IDs 1 and 2, respectively). In another embodiment, first and/or second amino acid sequences are derived from Toxins A and/or B of toxinotype 3 (SEQ IDs 3 and 4, respectively).

Fusion proteins of the invention may further comprise a fusion protein partner to facilitate soluble expression. Fusion protein partners may be attached at the N- or C-terminus of the antigen construct but are usually placed at the N-terminal end. Examples of fusion partners are: NusA, thioredoxin, maltose-binding protein, small ubiquitin-like molecules (Sumo-tag). To facilitate removal of the fusion protein partner during purification, a unique protease site may be inserted between the fusion protein partner and the fusion protein per se. Such protease sites may include those for thrombin, factor Xa, enterokinase, PreScission™, Sumo™. Alternatively, removal of the fusion protein partner may be achieved via inclusion of an intein sequence between the fusion protein partner and the fusion protein per se. Inteins are self cleaving proteins and in response to a stimulus (e.g. lowered pH) are capable of self splicing at the junction between the intein and the antigen construct thus eliminating the need for the addition of specific proteases. Examples of inteins include domains derived from *Mycobacterium tuberculosis* (RecA), and *Pyrococcus horikoshii* (RadA) (Fong et al. (2010) Trends Biotechnol. 28:272-279).

To facilitate purification, fusion proteins of the invention may include one or more purification tags to enable specific chromatography steps (e.g. metal ion chelating, affinity chromatography) to be included in the purification processes. Such purification tags may, for example, include: repeat histidine residues (e.g. 6-10 histidine residues), maltose binding protein, glutathione S-transferase; and streptavidin. These tags may be attached at the N- and/or C-terminus of the antigen fusion proteins of the invention. To facilitate removal of such tags during purification, protease sites and/or inteins (examples above) may be inserted between the fusion protein and the purification tag(s).

Thus, a typical fusion protein construct of the invention (starting from the N-terminus) may comprise:
- a first purification tag
- a fusion protein partner (to facilitate expression)
- a first (preferably specific) protease sequence or intein sequence
- the Toxin A and/or B antigen sequence
- an optional second (preferably specific) protease sequence or intein sequence
- an optional second purification tag The first and second purification tags may be the same or different. Similarly, the first and second protease/intein sequence may be the same or different. The first and second options are preferably different to enable selective and controllable cleavage/purification.

Specific examples of such fusion protein constructs are show in SEQ ID NOs: 18-27.

In one embodiment spacers may be introduced to distance the purification tag from the fusion protein—this may help to increase binding efficiency to affinity purification column media. The spacer may be placed (immediately) after the purification tag or between the fusion protein partner and the fusion protein per se. Typical spacer sequences may consist of between 10-40 amino acid residues to give either a linear or alpha-helical structure.

Accordingly, in one embodiment, a fusion protein construct of the invention may comprise (starting from the N-terminus):
- a first purification tag
- an optional first spacer sequence
- a fusion protein partner (to facilitate expression)
- an optional second spacer sequence
- a (preferably specific) protease sequence or intein sequence
- the Toxin A and/or B derived antigen sequence
- an optional second (preferably specific) protease sequence or intein sequence
- an optional third spacer sequence
- an optional second purification tag Specific examples of such protein fusion constructs are show in SEQ ID NOs: 28-57.

Genes encoding the constructs of the invention may be generated by PCR from *C. difficile* genomic DNA and sequenced by standard methods to ensure integrity. Alternatively and preferably genes may be synthesised providing the optimal codon bias for the expression host (e.g. *E. coli*, *Bacillus megaterium*). Thus, the present invention provides corresponding nucleic acid sequences that encode the aforementioned fusion proteins of the present invention.

Accordingly, a second aspect of the present invention provides a method for expressing one or more of the aforementioned fusion proteins, said method comprising:
1) providing a nucleic acid sequence that encodes one or more of said fusion proteins in a host cell, wherein said nucleic acid sequence is operably linked to a promoter; and
2) expressing said nucleic acid sequence in the host cell Fusion proteins of the invention may be formulated as vaccines for human or animal use in a number of ways. For example, formulation may include treatment with an agent to introduce intra-molecular cross-links. One example of such an agent is formaldehyde, which may be incubated, for example, with antigen fusion proteins of the invention for between 1-24 hours. Alternatively, longer incubation times of, for example, up to 2, 4, 6, 8 or 10 days may be employed. Following treatment with such an agent, antigen fusions of the invention may be combined with a suitable adjuvant, which may differ depending on whether the antigen fusion protein is intended for human or animal use.

A human or animal vaccine formulation may contain Toxin A and/or Toxin B and/or corresponding hybrid/chimera antigen fusions of the present invention. Thus, in one embodiment, a vaccine formulation procedure of the present invention comprises the following steps:
- providing a recombinant Toxin A and/or Toxin B and/or hybrid/chimera toxin fusion protein in suitable buffer system
- optionally (preferably) treating said mixture with a toxoiding component such as formaldehyde
- optionally transferring the fusion proteins to a new buffer system
- combining the fusion proteins with one or more suitable adjuvants and optionally other excipients Accordingly, a third aspect of the present invention provides one or more of the aforementioned fusion proteins of the invention, for use in the generation of antibodies that bind to *C. difficile* Toxin A and/or Toxin B. In one embodiment, said antibodies bind to and neutralise *C. difficile* Toxin A and/or Toxin B.

For immunisation of animals, the *C. difficile* recombinant fusion protein antigens of the invention may be used as immunogens separately or in combination, either concurrently or sequentially, in order to produce antibodies specific for individual *C. difficile* toxins or combinations. For example, two or more recombinant antigens may be mixed together and used as a single immunogen. Alternatively a *C. difficile* toxin fusion protein antigen (e.g. Toxin A-derived) may be used separately as a first immunogen on a first animal group, and another *C. difficile* toxin antigen (e.g. Toxin B-derived) may be used separately on a second animal group. The antibodies produced by separate immunisation may be combined to yield an antibody composition directed against *C. difficile* toxins. Non-limiting examples of suitable adjuvants for animal/veterinary use include Freund's (complete and incomplete forms), alum (aluminium phosphate or aluminium hydroxide), saponin and its purified component Quil A.

A fourth (vaccine) aspect of the present invention provides one or more of the aforementioned fusion proteins of the invention, for use in the prevention, treatment or suppression of CDI (eg. in a mammal such as man). Put another way, the present invention provides a method for the prevention, treatment or suppression of CDI (eg. in a mammal such as man), said method comprising administration of a therapeutically effective amount of one or more of the aforementioned fusion proteins of the invention to a subject (eg. a mammal such as man).

By way of example, a Toxin A-based fusion protein (any A toxinotype) may be employed alone or in combination with a Toxin B-based fusion protein (any B toxinotype). Similarly, a Toxin B-based fusion protein (any B toxinotype) may be employed alone or in combination with a Toxin A-based fusion protein (any A toxinotype). Said fusion proteins may be administered in a sequential or simultaneous manner. Vaccine applications of the present invention may further include the combined use (e.g. prior, sequential or subsequent administration) of one or more antigens such as a *C. difficile* antigen (e.g. a non-Toxin antigen; or a *C. difficile* bacterium such as one that has been inactivated or attenuated), and optionally one or more nosocomial infection antigens (e.g. an antigen, notably a surface antigen, from a bacterium that causes nosocomial infection; and/or a bacterium that causes a nosocomial infection such as one that has been inactivated or attenuated). Examples of bacteria that cause nosocomial infection include one or more of: *E. coli, Klebsiella pneumonae, Staphylococcus aureus* such as MRSA, *Legionella, Pseudomonas aeruginosa, Serratia marccsccns, Enterobacter* spp, *Citrobacter* spp, *Stenotrophomaonas maltophilia, Acinetobacter* spp such as *Acinetobacter baumannii, Burkholderia ccpacia*, and *Enterococcus* such as vancomycin-resistant *Enterococcus* (VRE).

In one embodiment, said vaccine application may be employed prophylactically, for example to treat a patient before said patient enters a hospital (or similar treatment facility) to help prevent hospital-acquired infection. Alternatively, said vaccine application may be administered to vulnerable patients as a matter of routine.

A related vaccine aspect of the invention provides one or more antibodies (comprising or consisting whole IgG and/or Fab and/or F(ab')2 fragments) that binds to the one or more aforementioned fusion proteins of the invention, for use in the prevention, treatment or suppression of CDI (eg. in a mammal such as man). Put another way, the present invention provides a method for the prevention, treatment or suppression of CDI (eg. in a mammal such as man), said method comprising administration of a therapeutically effective amount of said antibody (or antibodies) to a subject (eg. a mammal such as man).

By way of example, an anti-Toxin A-based fusion protein (any A toxinotype) antibody may be employed alone or in combination with an anti-Toxin B-based fusion protein (any B toxinotype) antibody. Similarly, an anti-Toxin B-based fusion protein (any B toxinotype) antibody may be employed alone or in combination with an anti-Toxin A-based fusion protein (any A toxinotype) antibody. Said antibodies may be administered in a sequential or simultaneous manner. Vaccine applications of the present invention may further include the combined use (e.g. prior, sequential or subsequent administration) of one or more antibodies that bind to antigens such as a *C. difficile* antigen (e.g. a non-Toxin antigen; or a *C. difficile* bacterium), and optionally one or more antibodies that bind to one or more nosocomial infection antigens (e.g. an antigen, notably a surface antigen, from a bacterium that causes nosocomial infection; and! or a bacterium that causes a nosocomial infection). Examples of bacteria that cause nosocomial infection include one or more of: *E. coli, Klebsiella pneumonae, Staphylococcus aureus* such as MRSA, *Legionella, Pseudomonas aeruginosa, Serratia marccsccns, Enterobacter* spp, *Citrobacter* spp, *Stenotrophomonas maltophilia, Acinetobacter* spp such as *Acinetobacter baumannii, Burkholderia ccpacia*, and *Enterococcus* such as vancomycin-resistant *Enterococcus* (VRE).

In one embodiment, said vaccine application may be employed prophylactically, for example once a patient has entered hospital (or similar treatment facility). Alternatively, said vaccine application may be administered to patients in combination with one or more antibiotics.

In one embodiment, said antibodies have been generated by immunisation of an animal (eg. a mammal such as man, or a non-human animal such as goat or sheep) with one or more of the aforementioned fusion proteins of the present invention.

In one embodiment, the antibodies of the present invention do not (substantially) bind to the effector domain and/or to the cysteine protease domain of a *C. difficile* Toxin A and/or Toxin B.

For the preparation of vaccines for human (or non-human animal) use, the active immunogenic ingredients (whether these be antigenic fusion protein/s of the present invention and/or corresponding antibodies of the invention that bind thereto) may be mixed with carriers or excipients, which are pharmaceutically acceptable and compatible with the active ingredient. Suitable carriers and excipients include, for example, water, saline, dextrose, glycerol, ethanol, or the like and combinations thereof. In addition, if desired, the vaccine may contain minor amounts of auxiliary substances such as wetting or emulsifying agents, pH buffering agents, and/or adjuvants which enhance the effectiveness of the vaccine.

The vaccine may further comprise one or more adjuvants. One non-limiting example of an adjuvant with the scope of the invention is aluminium hydroxide. Other non-limiting examples of adjuvants include but are not limited to: N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+ TDM+CWS) in a 2% squalene/Tween 80 emulsion.

Typically, the vaccines are prepared as injectables, either as liquid solutions or suspensions. Of course, solid forms suitable for solution in, or suspension in, liquid prior to injection may also be prepared. The preparation may also be emulsified, or the peptide encapsulated in liposomes or microcapsules.

Vaccine administration is generally by conventional routes e.g. intravenous, subcutaneous, intraperitoneal, or mucosal routes. The administration may be by parenteral injection, for example, a subcutaneous or intramuscular injection.

The vaccines are administered in a manner compatible with the dosage formulation, and in such amount as will be prophylactically and/or therapeutically effective. The quantity to be administered, which is generally in the range of 5 micrograms to 250 micrograms of antigen per dose, depends on the subject to be treated, capacity of the subject's immune system to synthesize antibodies, and the degree of protection desired. Precise amounts of active ingredient required to be administered may depend on the judgment of the practitioner and may be particular to each subject.

The vaccine may be given in a single dose schedule, or optionally in a multiple dose schedule. A multiple dose schedule is one in which a primary course of vaccination may be with 1-6 separate doses, followed by other doses given at subsequent time intervals required to maintain and for reinforce the immune response, for example, at 1-4 months for a second dose, and if needed, a subsequent dose(s) after several months. The dosage regimen will also, at least in part, be determined by the need of the individual and be dependent upon the judgment of the practitioner.

In addition, the vaccine containing the immunogenic antigen(s) may be administered in conjunction with other immunoregulatory agents, for example, immunoglobulins, antibiotics, interleukins (e.g., IL-2, IL-12), and/or cytokines (e.g., IFN gamma)

Additional formulations suitable for use with the present invention include microcapsules, suppositories and, in some cases, oral formulations or formulations suitable for distribution as aerosols. For suppositories, traditional binders and carriers may include, for example, polyalkylene glycols or triglycerides; such suppositories may be formed from mixtures containing the active ingredient in the range of about 0.5% to 10%, including for instance, about 1%-2%.

Fusion proteins of the invention may also have uses as ligands for use in affinity chromatography procedures. In such procedures, fusion proteins of the invention may be covalently immobilised onto a matrix, such as Sepharose, e.g. using cyanogen bromide-activated Sepharose. Such affinity columns may then be used to purify antibody from antisera or partially purified solutions of immunoglobulins by passing them through the column and then eluting the bound IgG fraction (e.g. by low pH). Almost all of the antibody in the eluted fraction will be directed against the fusion proteins of the invention, with non-specific antibodies and other proteins having been removed. These affinity purified IgG fractions have applications both as immunotherapeutics and as reagents in diagnostics. For immunotherapeutics, affinity purified antibodies enable a lower dose to be administered making adverse side effects less likely. For diagnostics, affinity purified agents often give improved specificity and fewer false positive results.

Definitions Section

*Clostridium difficile* is a species of Gram-positive bacterium of the genus *Clostridium*.

*Clostridium difficile* infection (CDI) means a bacterial infection which affects humans and animals and which results in a range of symptoms from mild self-limiting diarrhoea to life-threatening conditions such as pseudomembranous colitis and cytotoxic megacolon. In this disease, *C. difficile* replaces some of the normal gut flora and starts to produce cytotoxins which attack and damage the gut epithelium. Primary risk factors for human CDI include: receiving broad-spectrum antibiotics, being over 65 years old and being hospitalised.

*Clostridium difficile* Toxin A is a family of protein cytotoxins/enterotoxins of approximately 300 kDa in size. Toxin A has an enzyme activity within the N-terminal region which acts to disrupt the cytoskeleton of the mammalian cell causing cell death. There a number of naturally occurring variants of Toxin A within the strains of *Clostridium difficile* which are called 'toxinotypes'. The various toxinotypes of Toxin A have variations within their primary sequence of usually <10% overall. Examples of suitable Toxin A sequences include SEQ ID NOs: 1 and 3.

*Clostridium difficile* Toxin B is a family of protein cytotoxins of approximately 270 kDa in size which are similar to Toxin A but significantly more cytotoxic. Like Toxin A, Toxin B has an enzyme activity within the N-terminal region which acts to disrupt the cytoskeleton of the mammalian cell causing cell death. There are a number of naturally occurring variants of Toxin B within the strains of *C. difficile* which are called loxinotypes'. The various toxinotypes of Toxin B have variations within their primary sequence of up to 15% overall. Examples of suitable Toxin B sequences include SEQ ID NOs: 2 and 4.

*C. difficile* repeat units are regions within the C-terminus of Toxin A and B that contain repeating motifs which were first identified by von Eichel-Streiber and Sauerborn (1990; Gene 30: 107-113). In the case of Toxin A there are 31 short repeats and 7 long repeats with each repeat consisting of a 8-hairpin followed by a loop. Toxin B consists of a similar structure but with fewer repeats. The repeat units of Toxin A are contained within residues 1850-2710 and those for Toxin B within residues 1852-2366. The repeat regions play a role in receptor binding. The receptor binding regions (i.e. that define the toxin's structural binding pockets) appear to be clustered around the long repeat regions to form 'binding modules' (see Tables 1 and 2).

Central domains of Toxin A and B are believed to play a role in translocation of the toxins into mammalian cells. The central domains of Toxin A are based on residues 543-1849 and those for Toxin B are based on residues 543-1851. Of the central domain regions of Toxins A and B, the first domain is a cysteine protease, which plays a role in the internalisation of the toxin's effector domain (which contains the glucosyl transferase activity).

Toxinotypes are often used to classify strains of *C. difficile*. Toxinotyping is based on a method which characterises the restriction patterns obtained with the toxin genes. Toxinotypes of Toxins A and B represent variants, by primary amino acid sequence, of these protein toxins. In one embodiment, the *C. difficile* toxin is selected from one of toxinotypes 0 to XV. Preferred Toxinotypes (plus example Ribotypes and Strains) are listed in the Table immediately below. The listed Toxinotypes are purely illustrative and are not intended to be limiting to the present invention

| Toxinotype | Example Ribotypes | Example Strains | Reference |
|---|---|---|---|
| 0 | 001, 106 | VPI10463 | Rupnik et al. |
| 1 | 003, 012, 102 | EX623 | (1998) |
| 2 | 103 | AC008 | J. Clinical |
| 3 | 027, 034, 075, 080 | R20291, QCD-32g58 | Microbiol. |
| 4 | 023, 034, 075, 080 | 55767 | 36: 2240-2247 |
| 5 | 066, 078 | SE881 | |
| 6 | 045, 063, 066 | 51377 | |
| 7 | 063 | 57267 | |
| 8 | 017, 047 | 1470 | |
| 9 | 019 | 51680 | |
| 10 | 036 | 8864 | |
| 11 | 033 | IS58, R11402 | Rupnik et al. |
| 12 | 056 | IS25 | (2001) |
| 13 | 070 | R9367 | Microbiology |
| 14 | 111 | R10870 | 147: 439-447 |
| 15 | 122 | R9385 | |

An "antibody" is used in the broadest sense and specifically covers polyclonal antibodies and antibody fragments so long as they exhibit the desired biological activity. For example, an antibody is a protein including at least one or two, heavy (H) chain variable regions (abbreviated herein as VHC), and at least one or two light (L) chain variable regions (abbreviated herein as VLC). The VHC and VLC regions can be further subdivided into regions of hypervariability, termed "complementarity determining regions" ("CDR"), interspersed with regions that are more conserved, termed "framework regions" (FR). The extent of the framework region and CDRs has been precisely defined (see, Kabat, E. A., et al. Sequences of Proteins of Immunological Interest, Fifth Edition, U.S. Department of Health and Human Services, NIH Publication No. 91-3242, 1991, and Chothia, C. et al, J. Mol. Biol. 196:901-917, 1987, which are incorporated herein by reference). Preferably, each VHC and VLC is composed of three CDRs and four FRs, arranged from amino-terminus to carboxy-terminus in the following order: FR1, CDR1, FR2, CDR2, FR3, CDR3, FR4.

The VHC or VLC chain of the antibody can further include all or part of a heavy or light chain constant region. In one embodiment, the antibody is a tetramer of two heavy immunoglobulin chains and two light immunoglobulin chains, wherein the heavy and light immunoglobulin chains are inter-connected by, e.g., disulfide bonds. The heavy chain constant region includes three domains, CH1, CH2 and CH3. The light chain constant region is comprised of one domain, CL. The variable region of the heavy and light chains contains a binding domain that interacts with an antigen. The constant regions of the antibodies typically mediate the binding of the antibody to host tissues or factors, including various cells of the immune system (e.g., effector cells) and the first component (C1q) of the classical complement system. The term "antibody" includes intact immunoglobulins of types IgA, IgG, IgE, IgD, IgM (as well as subtypes thereof), wherein the light chains of the immunoglobulin may be of types kappa or lambda.

The term antibody, as used herein, also refers to a portion of an antibody that binds to a toxin of *C. difficile* (e.g. Toxin A or B), e.g., a molecule in which one or more immunoglobulin chains is not full length, but which binds to a toxin. Examples of binding portions encompassed within the term antibody include (i) a Fab fragment, a monovalent fragment consisting of the VLC, VHC, CL and CH1 domains; (ii) a F(ab')₂ fragment, a bivalent fragment comprising two Fab fragments linked by a disulfide bridge at the hinge region; (iii) a Fc fragment consisting of the VHC and CH1 domains; (iv) a Fv fragment consisting of the VLC and VHC domains of a single arm of an antibody, (v) a dAb fragment (Ward et al., (1989) Nature 341:544-546), which consists of a VHC domain; and (vi) an isolated complementarity determining region (CDR) having sufficient framework to bind, e.g. an antigen binding portion of a variable region. An antigen binding portion of a light chain variable region and an antigen binding portion of a heavy chain variable region, e.g., the two domains of the Fv fragment, VLC and VHC, can be joined, using recombinant methods, by a synthetic linker that enables them to be made as a single protein chain in which the VLC and VHC regions pair to form monovalent molecules (known as single chain Fv (scFv); see e.g., Bird et al. (1988) Science 242:423-426; and Huston et al. (1988) Proc. Natl. Acad. Sci. USA 85:5879-5883). Such single-chain antibodies (as well as camelids) are also encompassed within the term antibody. These are obtained using conventional techniques known to those with skill in the art, and the portions are screened for utility in the same manner as are intact antibodies.

The term "fragment" means a peptide typically having at least seventy, preferably at least eighty, more preferably at least ninety percent of the consecutive amino acid sequence of the reference sequence.

The term "variant" means a peptide or peptide fragment having at least eighty, preferably at least eighty five, more preferably at least ninety percent amino acid sequence homology with a *C. difficile* toxin polypeptide. For sequence comparison, typically one sequence acts as a reference sequence, to which test sequences may be compared. When using a sequence comparison algorithm, test and reference sequences are input into a computer, subsequent coordinates are designated, if necessary, and sequence algorithm program parameters are designated. The sequence comparison algorithm then calculates the percentage sequence identity for the test sequence(s) relative to the reference sequence, based on the designated program parameters.

Any of a variety of sequence alignment methods can be used to determine percent identity, including, without limitation, global methods, local methods and hybrid methods, such as, e.g., segment approach methods. Protocols to determine percent identity are routine procedures within the scope of one skilled in the art. Global methods align sequences from the beginning to the end of the molecule and determine the best alignment by adding up scores of individual residue pairs and by imposing gap penalties. Non-limiting methods include, e.g., CLUSTAL W, see, e.g., Julie D. Thompson et al., CLUSTAL W: Improving the Sensitivity of Progressive Multiple Sequence Alignment Through Sequence Weighting, Position—Specific Gap Penalties and Weight Matrix Choice, 22(22) Nucleic Acids Research 4673-4680 (1994); and iterative refinement, see, e.g., Osamu Gotoh, Significant Improvement in Accuracy of Multiple Protein. Sequence Alignments by Iterative Refinement as Assessed by Reference to Structural Alignments, 264(4) J. Mol. Biol. 823-838 (1996). Local methods align sequences by identifying one or more conserved motifs shared by all of the input sequences. Non-limiting methods include, e.g., Match-box, see, e.g., Eric Depiereux and Ernest Feytmans, Match-Box: A Fundamentally New Algorithm for the Simultaneous Alignment of Several Protein Sequences, 8(5) CABIOS 501-509 (1992); Gibbs sampling, see, e.g., C. E. Lawrence et al., Detecting Subtle Sequence Signals: A Gibbs Sampling Strategy for Multiple Alignment, 262(5131) Science 208-214 (1993); Align-M, see, e.g., Ivo Van Walle et al., Align-M—A New Algorithm for Multiple Alignment of Highly Divergent Sequences, 20(9) Bioinformatics: 1428-1435 (2004).

Thus, percent sequence identity is determined by conventional methods. See, for example, Altschul et al., *Bull. Math. Bio.* 48: 603-16, 1986 and Henikoff and Henikoff, *Proc. Natl. Acad. Sci. USA* 89:10915-19, 1992. Briefly, two amino acid sequences are aligned to optimize the alignment scores using a gap opening penalty of 10, a gap extension penalty of 1, and the "blosum 62" scoring matrix of Henikoff and Henikoff (ibid.) as shown below (amino acids are indicated by the standard one-letter codes).

Alignment scores for determining sequence identity

|   | A | R | N | D | C | Q | E | G | H | I | L | K | M | F | P | S | T | W | Y | V |
|---|---|---|---|---|---|---|---|---|---|---|---|---|---|---|---|---|---|---|---|---|
| A | 4 | | | | | | | | | | | | | | | | | | | |
| R | -1 | 5 | | | | | | | | | | | | | | | | | | |
| N | -2 | 0 | 6 | | | | | | | | | | | | | | | | | |
| D | -2 | -2 | 1 | 6 | | | | | | | | | | | | | | | | |
| C | 0 | -3 | -3 | -3 | 9 | | | | | | | | | | | | | | | |
| Q | -1 | 1 | 0 | 0 | -3 | 5 | | | | | | | | | | | | | | |
| E | -1 | 0 | 0 | 2 | -4 | 2 | 5 | | | | | | | | | | | | | |
| G | 0 | -2 | 0 | -1 | -3 | -2 | -2 | 6 | | | | | | | | | | | | |
| H | -2 | 0 | 1 | -1 | -3 | 0 | 0 | -2 | 8 | | | | | | | | | | | |
| I | -1 | -3 | -3 | -3 | -1 | -3 | -3 | -4 | -3 | 4 | | | | | | | | | | |
| L | -1 | -2 | -3 | -4 | -1 | -2 | -3 | -4 | -3 | 2 | 4 | | | | | | | | | |
| K | -1 | 2 | 0 | -1 | -3 | 1 | 1 | -2 | -1 | -3 | -2 | 5 | | | | | | | | |
| M | -1 | -1 | -2 | -3 | -1 | 0 | -2 | -3 | -2 | 1 | 2 | -1 | 5 | | | | | | | |
| F | -2 | -3 | -3 | -3 | -2 | -3 | -3 | -3 | -1 | 0 | 0 | -3 | 0 | 6 | | | | | | |
| P | -1 | -2 | -2 | -1 | -3 | -1 | -1 | -2 | -2 | -3 | -3 | -1 | -2 | -4 | 7 | | | | | |
| S | 1 | -1 | 1 | 0 | -1 | 0 | 0 | 0 | -1 | -2 | -2 | 0 | -1 | -2 | -1 | 4 | | | | |

-continued

| | A | R | N | D | C | Q | E | G | H | I | L | K | M | F | P | S | T | W | Y | V |
|---|---|---|---|---|---|---|---|---|---|---|---|---|---|---|---|---|---|---|---|---|
| T | 0 | -1 | 0 | -1 | -1 | -1 | -1 | -2 | -2 | -1 | -1 | -1 | -1 | -2 | -1 | 1 | 5 | | | |
| W | -3 | -3 | -4 | -4 | -2 | -2 | -3 | -2 | -2 | -3 | -2 | -3 | -1 | 1 | -4 | -3 | -2 | 11 | | |
| Y | -2 | -2 | -2 | -3 | -2 | -1 | -2 | -3 | 2 | -1 | -1 | -2 | -1 | 3 | -3 | -2 | -2 | 2 | 7 | |
| V | 0 | -3 | -3 | -3 | -1 | -2 | -2 | -3 | -3 | 3 | 1 | -2 | 1 | -1 | -2 | -2 | 0 | -3 | -1 | 4 |

The percent identity is then calculated as:

$$\frac{\text{Total number of identical matches}}{\left[\begin{array}{c}\text{length of the longer sequence plus the}\\ \text{number of gaps introduced into the longer}\\ \text{sequence in order to align the two sequences}\end{array}\right]} \times 100$$

Substantially homologous polypeptides are characterized as having one or more amino acid substitutions, deletions or additions. These changes are preferably of a minor nature, that is conservative amino acid substitutions (see below) and other substitutions that do not significantly affect the folding or activity of the polypeptide; small deletions, typically of one to about 30 amino acids; and small amino- or carboxyl-terminal extensions, such as an amino-terminal methionine residue, a small linker peptide of up to about 20-25 residues, or an affinity tag.

Conservative Amino Acid Substitutions
Basic: arginine
   lysine
   histidine
Acidic: glutamic acid
   aspartic acid
Polar: glutamine
   asparagine
Hydrophobic: leucine
   isoleucine
   valine
Aromatic: phenylalanine
   tryptophan
   tyrosine
Small: glycine
   alanine
   serine
   threonine
   methionine In addition to the 20 standard amino acids, non-standard amino acids (such as 4-hydroxyproline, 6-N-methyl lysine, 2-aminoisobutyric acid, isovaline and α-methyl serine) may be substituted for amino acid residues of the polypeptides of the present invention. A limited number of non-conservative amino acids, amino acids that are not encoded by the genetic code, and unnatural amino acids may be substituted for clostridial polypeptide amino acid residues. The polypeptides of the present invention can also comprise non-naturally occurring amino acid residues.

Non-naturally occurring amino acids include, without limitation, trans-3-methylproline, 2,4-methano-proline, cis-4-hydroxyproline, trans-4-hydroxy-proline, N-methylglycine, allo-threonine, methyl-threonine, hydroxy-ethylcysteine, hydroxyethylhomo-cysteine, nitro-glutamine, homoglutamine, pipecolic acid, tert-leucine, norvaline, 2-azaphenylalanine, 3-azaphenyl-alanine, 4-azaphenyl-alanine, and 4-fluorophenylalanine. Several methods are known in the art for incorporating non-naturally occurring amino acid residues into proteins. For example, an in vitro system can be employed wherein nonsense mutations are suppressed using chemically aminoacylated suppressor tRNAs. Methods for synthesizing amino acids and aminoacylating tRNA are known in the art. Transcription and translation of plasmids containing nonsense mutations is carried out in a cell free system comprising an *E. coli* S30 extract and commercially available enzymes and other reagents. Proteins are purified by chromatography. See, for example, Robertson et al., *J. Am. Chem. Soc.* 113:2722, 1991; Ellman et al., *Methods Enzymol.* 202:301, 1991; Chung et al., *Science* 259:806-9, 1993; and Chung et al., *Proc. Natl. Acad. Sci. USA* 90:10145-9, 1993). In a second method, translation is carried out in *Xenopus* oocytes by microinjection of mutated mRNA and chemically aminoacylated suppressor tRNAs (Turcatti et al., *J. Biol. Chem.* 271:19991-8, 1996). Within a third method, *E. coli* cells are cultured in the absence of a natural amino acid that is to be replaced (e.g., phenylalanine) and in the presence of the desired non-naturally occurring amino acid(s) (e.g., 2-azaphenylalanine, 3-azaphenylalanine, 4-azaphenylalanine, or 4-fluorophenylalanine). The non-naturally occurring amino acid is incorporated into the polypeptide in place of its natural counterpart. See, Koide et al., Biochem. 33:7470-6, 1994. Naturally occurring amino acid residues can be converted to non-naturally occurring species by in vitro chemical modification. Chemical modification can be combined with site-directed mutagenesis to further expand the range of substitutions (Wynn and Richards, *Protein Sci.* 2:395-403, 1993).

A limited number of non-conservative amino acids, amino acids that are not encoded by the genetic code, non-naturally occurring amino acids, and unnatural amino acids may be substituted for amino acid residues of polypeptides of the present invention.

Essential amino acids in the polypeptides of the present invention can be identified according to procedures known in the art, such as site-directed mutagenesis or alanine-scanning mutagenesis (Cunningham and Wells, *Science* 244:1081-5, 1989). Sites of biological interaction can also be determined by physical analysis of structure, as determined by such techniques as nuclear magnetic resonance, crystallography, electron diffraction or photoaffinity labeling, in conjunction with mutation of putative contact site amino acids. See, for example, de Vos et al., *Science* 255:306-12, 1992; Smith et al., *J. Mol. Biol.* 224:899-904, 1992; Wlodaver et al., *FEBS Lett.* 309:59-64, 1992. The identities of essential amino acids can also be inferred from analysis of homologies with related components (e.g. the translocation or protease components) of the polypeptides of the present invention.

Multiple amino acid substitutions can be made and tested using known methods of mutagenesis and screening, such as those disclosed by Reidhaar-Olson and Sauer (*Science* 241:53-7, 1988) or Bowie and Sauer (*Proc. Natl. Acad. Sci. USA* 86:2152-6, 1989). Briefly, these authors disclose methods for simultaneously randomizing two or more positions in a polypeptide, selecting for functional polypeptide, and then sequencing the mutagenised polypeptides to determine the spectrum of allowable substitutions at each position. Other methods that can be used include phage display (e.g., Lowman et al., Biochem. 30:10832-7, 1991; Ladner et al., U.S. Pat. No. 5,223,409; Huse, WIPO Publication WO 92/06204) and region-directed mutagenesis (Derbyshire et al., Gene 46:145, 1986; Ner et al., DNA 7:127, 1988).

Toxin-neutralising means the capacity of a substance to prevent the cytotoxic action of either Toxin A or B on a mammalian cell. In assays for toxin-neutralising activity, a fixed amount of toxin is mixed with various concentrations of a neutralising substance (e.g. an antibody) and the mixture applied to and incubated with a mammalian cell line (e.g. Vero cells) for a fixed time. The dilution of the substance (antibody) that completely protects the cells from the cytotoxic effects of either Toxin A or B (evident by cell rounding) may be defined as the neutralising titre.

DESCRIPTION OF THE FIGURES

FIG. 1 illustrates to structures of C. difficile Toxins A and B showing amino acid residues at the various domain boundaries.

EXAMPLES

Figure 2:
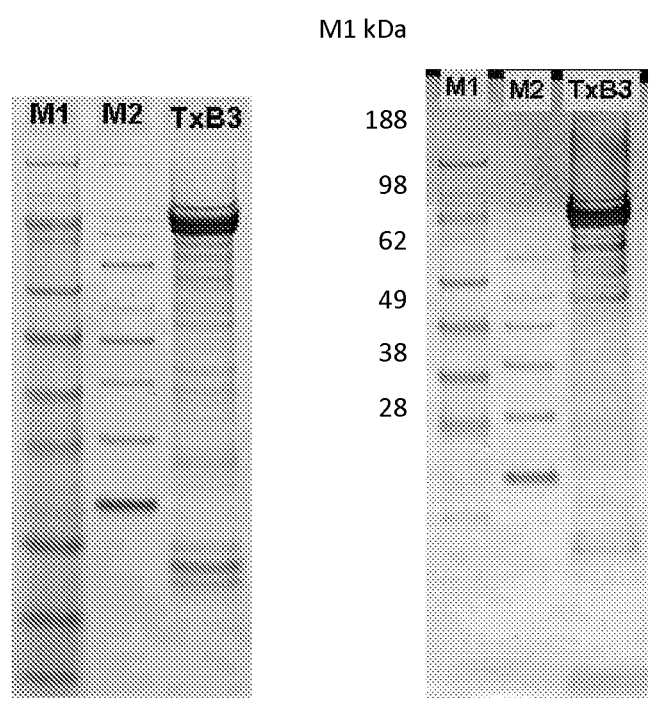
FIG. 2 illustrates TxB3 purification. The left-hand Figure shows a 4-12% SDS-PAGE analysis of TxB3. M1=SeeBlue® Plus2 Pre-Stained Standard, M2=MagicMark™ XP Standard. The right-hand Figure shows a Western blot analysis of TxB3 with ovine anti-TcdB polyclonal antibodies. M1 and M2 are as described for the left-hand Figure.
Figure 3:
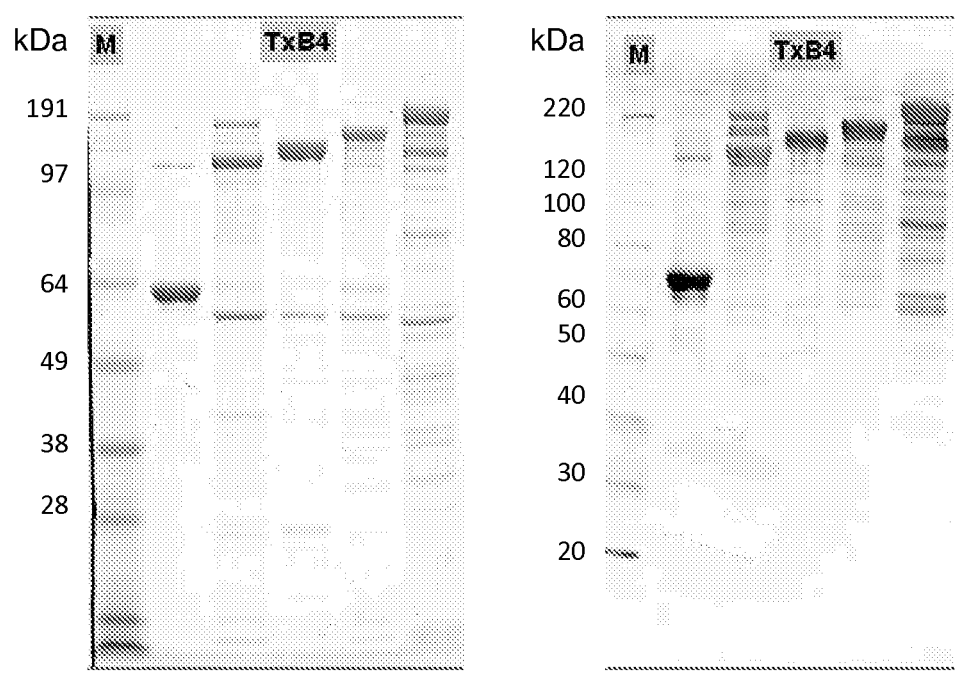
FIG. 3 illustrates TxB4 purification. The left-hand Figure shows a 4-12% SDS-PAGE analysis of TxB4. M=SeeBlue® Plus2 Pre-Stained Standard. The right-hand Figure shows a Western blot analysis of TxB4 with ovine anti-TcdB polyclonal antibodies, M=MagicMark™ XP Standard.
Figure 4:
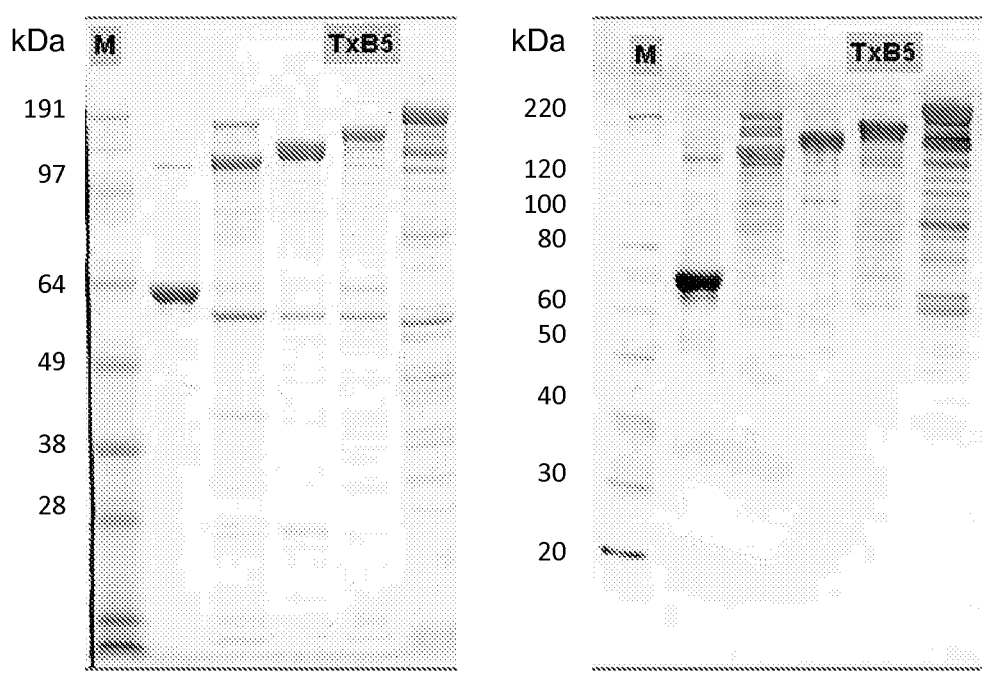
FIG. 4 illustrates TxB5 purification. The left-hand Figure shows a 4-12% SDS-PAGE analysis of TxB5. M=SeeBlue® Plus2 Pre-Stained Standard. The right-hand Figure shows a Western blot analysis of TxB5 with ovine anti-TcdB polyclonal antibodies, M=MagicMark™ XP Standard.
Figure 5:
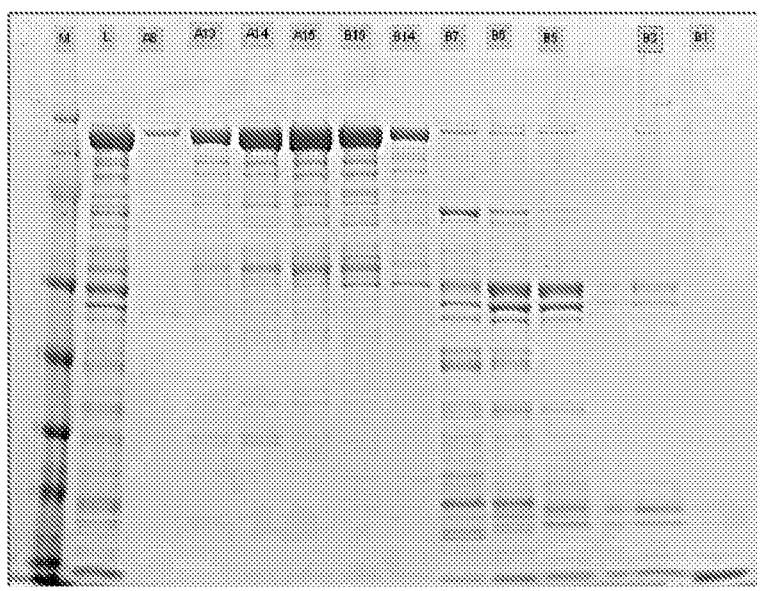
FIG. 5 illustrates TxA4 purification and SDS-PAGE analysis of the nickel affinity purification of HRV3C protease treated TxA4. M=Molecular weight markers, L=column load, A8=column flow-through. Fractions A14-B14 showed the purified TxA4.

Example 1—Cloning and Expression of Antigens Derived from Toxins A and B

Genes encoding these peptides may be made commercially with codon bias for any desired expression host (e.g. E. coli, Pichia pastoris). Peptides are expressed from these genes using standard molecular biology methods (e.g. Sambrook et al. 1989, Molecular Cloning a Laboratory Manual, Second Edition, Cold Spring Harbor Laboratory Press, Cold Spring Harbor, N.Y.). One convenient method of cloning is the Gateway® system (Invitrogen) which allow genetic constructs to be assembled in a modular fashion.

Protocol 1: The Gateway LR Recombination Reaction—a General Protocol

Materials: Antigen gene (Toxin A or B)) entry clones were synthesised by Entelechon. Gateway® LR Clonase™ II Enzyme Mix was purchased from Invitrogen. Gateway® Nova pET Destination vectors were purchased from Calbiochem Nova, part of Merck Chemicals Ltd.

Toxin A or B entry clone (1 µl), destination vector (1 µl) and TE buffer (6 µl) were mixed at room temperature in a 1.5 ml microcentrifuge tube. LR Clonase™ II was placed on ice for two minutes and mixed briefly with vortexing (2×2 s). The clonase enzyme (2 µl) was added to the microcentrifuge tube and the components mixed with gentle pipetting. Recombinations were incubated at 25° C. for 1 hour. Proteinase K solution (1 µl, 2 µg/µl) was added and the reactions incubated at 37° C. for 10 minutes. The resultant solution (1 µl) was used to transform chemically competent E. coli.

Protocol 2: Transformation of Chemically Competent Cells—a General Protocol

Materials: OneShot® BL21 Star™ (DE3) and One Shot® TOP10 chemically competent E. coli and SOC media were purchased from Invitrogen. Ampicillin was purchased from Sigma Aldrich.

LR recombination reaction or plasmid DNA (1 µl) was pipetted into an aliquot (50 µl) of BL21 Star™ or TOP10 chemically competent E. coli. The mixture was incubated on ice for 30 minutes and subsequently heat shocked in a water bath at 42° C. for 30 seconds. The cell aliquot was returned to the ice and SOC media (250 µl) added. Transformations were maintained in SOC media at 37° C. for 1 hour with orbital shaking (180 rpm). Transformation culture (100-200 µl) was plated out onto LB agar supplemented with ampicillin (100 µg/ml). The plates were incubated at 37° C. for 15 minutes, inverted and maintained at the same temperature overnight.

Example 2—Purification of Antigens of the Invention—Expression and Purification of C. difficile Toxin B Fragment TxB3

Toxin B-derived antigen TxB3(-h) (eg. Seq ID 9) was expressed as a thioredoxin fusion protein (Seq ID 27).

An N-his$_6$-thioredoxin fusion of TxB3 was expressed in BL21 Star™ (DE3) E. coli harbouring plasmid pDest59TxB3. LB media (3×20 ml) supplemented with 100 µg/ml ampicillin and 0.5% glucose was inoculated from a glycerol cell stock (cell culture<OD$_{600}$ 1 [500 µl]+glycerol [125 µl]). Cultures were maintained at 37° C. for 6-7 hours with orbital shaking (180 rpm). Each culture was used to inoculate LB media (100 ml) supplemented with 100 µg/ml ampicillin and 0.5% glucose. Cultures were maintained at 37° C. for 1 hour with orbital shaking (180 rpm). Terrific Broth (3×1 L) supplemented with 100 µg/ml ampicillin and 0.1% glucose was inoculated with the LB culture (100 ml per liter) and maintained at 37° C. as before to an absorbance at 600 nm of 0.5. Expression was induced with the addition of IPTG to a final concentration of 1 mM and the cultures maintained at 16° C. overnight with orbital shaking (180 rpm). Cells were harvested by centrifugation for 30 minutes (3000 rpm, Sorvall RC3BP centrifuge, rotor #H6000A), resuspended in low imidazole buffer (100 ml, pH 7.4, 50 mM HEPES, 500 mM sodium chloride, 20 mM imidazole) and frozen at −80° C.

(i) Nickel Affinity Purification of the Thioredoxin TxB3 Fusion Protein

Cell paste was thawed at room temperature and then on ice until liquefied. Cells were disrupted with sonication (10 cycles of 30 s ON and 30 s OFF) and the resultant lysate cleared by centrifugation for 30 minutes (14,000 rpm, Sorvall RC5C centrifuge, rotor #SS-34). Cleared lysate was applied to fast flow chelating sepharose charged with nickel ions (40 ml bed volume) at a flow rate of 1 ml/min. The column was washed with low imidazole buffer (pH 7.4, 50 mM HEPES, 500 mM sodium chloride, 20 mM imidazole)

until the absorbance of the flow through at 280 nM returned to near baseline levels. Bound material was eluted with sequential steps to 15, 25 and 70% high imidazole buffer (pH 7.4, 50 mM HEPES, 500 mM sodium chloride, 500 mM imidazole). Material eluted at 70% high imidazole buffer was pooled and dialysed into thrombin cleavage buffer (20 mM Tris-HCl pH 8.4, 150 mM sodium chloride, 2.5 mM calcium chloride) overnight.

(ii) Thrombin Digestion of the Thioredoxin TxB3 Fusion Protein

Human thrombin (Novagen, 1 U per mg of total protein) was added to the pooled nickel column fractions which had been dialysed into thrombin cleavage buffer. The digest was incubated at 25° C. for 4 hours and frozen at −80° C. to prevent continued cleavage.

(iii) Nickel Affinity Purification of TxB3

The thrombin digest was thawed on ice and p-Aminobenzamidine resin added (0.1 ml drained resin per 6 U of thrombin). The mixture was gently rocked over ice for 30 minutes and the resin filtered off. The cleared filtrate was passed over fast flow chelating sepharose charge with nickel ions (6 ml bed volume) at a flow rate of 1 ml/min and the flow through pooled and dialysed into storage buffer (pH 7.4, 50 mM HEPES, 150 mM sodium chloride). The solution was sterile filtered into 1 ml aliquots. The total protein obtained was 10.5 mg, which was estimated to be 55% TxB3. Protein was also analysed by Western blotting with ovine anti-TcdB polyclonal antibodies (FIG. 2).

Example 3—Purification of Antigens of the Invention—Expression and Purification of *C. difficile* Toxin B Fragment TxB4

Large Scale Expression of the Nus TxB4 Fusion Protein

A bead from a −80° C. stock of BL21 Star (DE3) *E. coli* harbouring plasmid pDest57TxB4His was streaked onto L-agar supplemented with 100 μg/ml ampicillin and incubated at 37° C. overnight. A single colony was used to inoculate 2YT media (100 ml) supplemented with 100 μg/ml ampicillin and 0.5% glucose. The culture was maintained at 37° C. with orbital shaking (180 rpm) to an absorbance of 0.6 at 600 nm and used as a 5% inoculum for Terrific Broth (2×1 L) supplemented with 100 μg/ml ampicillin and 0.5% glucose. Cultures were maintained as before to an absorbance of 0.6 at 600 nm and the temperature lowered to 16° C. Protein expression was induced by the addition of IPTG to a final concentration of 1 mM following thermal equilibration and the culture maintained overnight. Cells were harvested by centrifugation for 30 minutes (3000 rpm, Sorvall RC3BP centrifuge, rotor #H6000A), resuspended in low imidazole buffer (1:4 cell paste to buffer w/v, 50 mM HEPES pH 7.4, 500 mM sodium chloride, 20 mM imidazole) and frozen at −80° C.

Nickel Affinity Purification of the Nus TxB4 Fusion Protein

Cell paste was thawed at room temperature and then on ice until liquefied. Cells were disrupted with sonication (15 cycles of 30 s ON and 30 s OFF) and the resultant lysate cleared by centrifugation for 30 minutes at 4° C. (16,000 rpm, Sorvall RC5C centrifuge, rotor #SS-34). Cleared lysate was applied to fast flow chelating sepharose charged with nickel ions (40 ml bed volume) at a flow rate of 2 ml/min. The column was washed with low imidazole buffer (pH 7.4, 50 mM HEPES, 500 mM sodium chloride, 20 mM imidazole) until the absorbance of the flow through at 280 nm returned to near baseline levels. Bound material was eluted with a step to 50 high imidazole buffer (pH 7.4, 50 mM HEPES, 500 mM sodium chloride, 500 mM imidazole). Material eluted from the column was analysed by SDS-PAGE and selected fractions pooled. Protein concentration was determined from the absorbance at 280 nm.

Thrombin Digestion of the Nus TxB4 Fusion Protein

To each 10 μg of protein, 5 μl of thrombin digest buffer (200 mM Tris-HCl pH 8.4, 1.5 M NaCl, 25 mM $CaCl_2$), 1 μl of Human thrombin (Novagen) diluted 200 fold in thrombin dilution buffer (50 mM sodium citrate, pH 6.5, 200 mM NaCl, 0.1% PEG-8000, 50% glycerol) and water to a volume of 50 μl were added. The protein was digested overnight at room temperature and dialysed into low imidazole buffer at 4° C.

Nickel Affinity Purification of TxB4

TxB4 in low imidazole buffer was applied to fast flow chelating sepharose charged with nickel ions (40 ml bed volume) at a flow rate of 3 ml/min. The column was washed with low imidazole buffer until the absorbance of the flow through at 280 nm returned to near baseline levels. The column was washed with 80 mM imidazole, protein eluting after the resultant initial peak in UV absorbance (280 nm) was collected and dialysed into storage buffer (50 mM HEPES pH 7.4, 150 mM sodium chloride). Protein was analysed by SDS-PAGE and Western blotting with ovine anti-TcdB polyclonal antibodies (FIG. 3).

Example 4—Expression and Purification of *C. difficile* Toxin B Fragment TxB5 (Residues 544-2366 of Toxin B)

Large Scale Expression of the Nus TxB5 Fusion Protein

An N-$his_6$-Nus fusion of TxB5 was expressed in BL21 Star™ (DE3) *E. coli* harbouring plasmid pDest57TxB5. An overnight culture in LB media supplemented with 100 μg/ml ampicillin was used as a 3% inoculum for Terrific Broth (3 L) supplemented with 100 μg/ml ampicillin. Cultures were maintained at 37° C. to an absorbance at 600 nm of 0.6 with orbital shaking (180 rpm). Expression was induced with the addition of IPTG to a final concentration of 1 mM and the cultures maintained at 16° C. overnight with orbital shaking (180 rpm). Cells (25 g) were harvested by centrifugation for 30 minutes (3000 rpm, Sorvall RC3BP centrifuge, rotor #H6000A) and resuspended in low imidazole buffer (250 ml, pH 7.4, 50 mM HEPES, 500 mM sodium chloride, 20 mM imidazole).

Nickel Affinity Purification of the Nus TxB5 Fusion Protein

Lysozyme (10 mg) was added to the resuspended cells and the mixture stirred for 15 minutes. Cells were disrupted with sonication (10 cycles of 30 s ON and 30 s OFF) and the resultant lysate cleared by centrifugation for 30 minutes (14,000 rpm, Sorvall RC5C centrifuge, rotor #SS-34). Half of the cleared lysate was applied to fast flow chelating sepharose charged with nickel ions (40 ml bed volume) at a flow rate of 2 ml/min. The column was washed with low imidazole buffer until the UV absorbance of the flow through at 280 nm returned to near baseline levels. Protein, including Nus TxB5, was eluted with a step to 38% (200 mM imidazole) high imidazole buffer (pH 7.4, 50 mM HEPES, 500 mM sodium chloride, 500 mM imidazole). The second half of the lysate was processed in the same manner and the pooled eluted protein dialysed overnight into high salt HIC buffer (pH 7.4, 50 mM HEPES, 750 mM ammonium sulphate).

Butyl-s Hydrophobic Interaction Chromatography Purification of Nus TxB5

Half of the pooled protein solution in high salt HIC buffer was applied to a column containing butyl-s-sepharose 6 fast flow resin (9 ml bed volume). The column was washed with high salt HIC buffer (pH 7.4, 50 mM HEPES, 750 mM ammonium sulphate) until the UV absorbance of the flow through at 280 nm returned to near baseline levels. Protein was eluted from the column with a step to 100% low salt HIC buffer ((pH 7.4, 50 mM HEPES). The other half of the protein from the first nickel column was purified in the same manner. The eluted protein was pooled in preparation for digestion with thrombin.

Thrombin Digestion of the Nus TxB5 Fusion Protein

Pooled protein from the HIC column (69 mg, 30 ml) was added to a solution containing 10× thrombin cleavage buffer (15 ml, 200 mM Tris-HCl pH 8.4, 1.5 M sodium chloride, 25 mM calcium chloride), deionised water (105 ml) and human thrombin (Novagen, 40 U). The solution was incubated at room temperature for 4 hours and PMSF added to a final concentration of 1 mM. The resultant protein including the TxB5 was dialysed into high salt HIC buffer.

Butyl-s Hydrophobic Interaction Chromatography Purification of TxB5

The TxB5 from the thrombin digest was purified in two batches. Each batch was applied in high salt HIC buffer (pH 7.4, 50 mM HEPES, 750 mM ammonium sulphate) to a column containing butyl-s-sepharose 6 fast flow resin (9 ml bed volume) at a flow rate of 1 ml/min. The column was washed with high salt HIC buffer until the UV absorbance of the flow through at 280 nm returned to near baseline levels. Protein was eluted from the column with a step to 100% low salt HIC buffer (pH 7.4, 50 mM HEPES). The eluted material was dialysed against buffer (pH 7.4, 50 mM HEPES) overnight.

Q Sepharose Ion Exchange Chromatography Purification of TxB5

The TxB5 in buffer (pH 7.4, 50 mM HEPES) was run through a column containing Q sepharose fast flow resin (5 ml bed volume) at a flow rate of 1 ml/min. The flow through was pooled and dialysed into storage buffer (pH 7.4, 50 mM HEPES, 150 mM sodium chloride). Approximately 20 mg of protein was produced, of this 60% was TxB5 based on SDS-PAGE analysis. The protein was frozen in 1 ml aliquots at −80° C. Protein was analysed by SDS-PAGE and Western blotting with ovine anti-TcdB polyclonal antibodies (FIG. 4).

Example 5—Expression and Purification of *C. difficile* Toxin a Fragment TxA4 (Residues 770-2710 of Toxin A)

Expression

L-broth (100 ml) supplemented with 50 μg/ml kanamycin and 0.2% glucose was inoculated with a scrape from a glycerol freeze (BL21 (DE3) *E. coli* harbouring plasmid pET28aHis$_6$TrxHRV3CαNaturalTxA4) and maintained overnight at 30° C. and 180 rpm. The overnight culture was used as a 2% inoculum for Terrific Broth (4×0.5 L in 2 L unbaffled flasks) supplemented with 50 μg/ml kanamycin and 0.2% glucose. Cultures were maintained at 37° C. with orbital shaking (180 rpm) to an absorbance at 600 nm of 0.6. The temperature of the cultures was reduced to 16° C. and protein expression induced with the addition of 1 mM IPTG. The culture was maintained overnight at 16° C. with orbital shaking as before. Cell paste (23 g) was harvested by centrifugation (Sorvall RC3BP centrifuge, H6000A rotor, 4000 g, 20 minutes). The paste was recovered from the centrifuge pots by resuspension in low imidazole buffer (pH 7.5, 50 mM Hepes, 0.5 M sodium chloride, 20 mM Imidazole) and stored at −80° C.

Immobilised Nickel Affinity Purification of the TxA4 Precursor

Cells (23 g) resuspended with 85 ml of low imidazole buffer (pH7.5, 50 mM Hepes, 0.5 M NaCl 20 mM imidazole) was subjected to lysis using sonication. The lysate was cleared by centrifugation (Sorvall RC5C centrifuge, SS-34 rotor, 20,000 g, 20 minutes) and applied to a 20 ml nickel column (Ø 26 mm) at a flow rate of 1.5 ml/min. The column was washed with ten column volumes of low imidazole buffer and bound protein eluted using a five column volume gradient to 100% high imidazole buffer (pH7.5, 50 mM Hepes, 0.5 M NaCl, 0.5 M imidazole). Fractions were analysed on 4-12% NuPAGE Bis-Tris polyacrylamide gels with coomassie staining.

Cleavage of the Fusion Partner and his$_6$-Tag

The purest fractions were pooled and dialysed against HRV3C cleavage buffer (2 L, pH 7.5, 20 mM Tris-HCl, 0.5 M NaCl) overnight at 4° C. HRV3C protease (10 U per mg of full length target protein) was added to the solution and incubated at 20° C. for five hours followed by 4° C. overnight.

Immobilised Nickel Affinity Purification of Post Cleavage TxA4

The protein solution (pH 7.5 20 mM Tris-HCl, 0.5 M NaCl) was passed over a 20 ml nickel column (Ø 26 mm) at a flow rate of 1.5 ml/min. Some protein was seen to elute in the flow through as judged by the UV absorbance. The column was given a short wash with the HRV3C cleavage buffer and the TxA4 eluted with 5% high imidazole buffer (pH7.5, 50 mM Hepes, 0.5 M NaCl, 0.5 M imidazole) at an imidazole concentration of 25 mM. The remaining proteins were eluted from the column with a four column volume gradient to 100% high imidazole buffer. The purest fractions were pooled and dialysed into storage buffer (pH 7.5 50 mM Hepes, 0.5 M NaCl). Fractions from the final purification column are shown in FIG. 5.

Example 6—Expression and Purification of *C. difficile* Toxin a Fragment TxA4 Truncated (Residues 770-2389 of Toxin A)

Expression

L-Broth (100 ml) supplemented with 100 μg/ml ampicillin and 0.5% glucose was inoculated with a colony (harbouring pET59His6TRXtcsαnaturalTxA4truncate) from an overnight growth on a L-agar plate supplemented with 100 μg/ml ampicillin and maintained overnight at 37° C. and 180 rpm. This was used as an inoculum for Terrific Broth (6×1000 mls in 2000 ml unbaffled flasks) supplemented with 100 μg/ml ampicillin and 0.5% glucose. Cultures were maintained at 37° C. with orbital shaking (180 rpm) to an absorbance at 600 nm of 0.6. The temperature of the cultures was reduced to 16° C. and protein expression induced with the addition of IPTG to a final concentration of 1 mM. The culture was maintained overnight at 16° C. with orbital shaking as before. Cell paste was harvested by centrifugation (Sorvall RC3BP centrifuge, H6000A rotor, 4000 g, 30 minutes). The paste was recovered from the centrifuge pots by re-suspension in Hepes buffer (50 mM Hepes pH 7.4, 0.5 M sodium chloride) and stored at −20° C.

Immobilised Nickel Affinity Purification of the TxA4 Truncate Precursor

Cells (44 g) re-suspended with 180 ml of Hepes buffer (50 mM Hepes pH 7.4, 500 mM NaCl) were subject to lysis using sonication. The lysate was clarified by centrifugation at 4000 rpm for 20 minutes (Heraeus Multifuge). The supernatant was retained and applied to a 64 ml Zinc Sepharose column (XK26×12) at a flow rate of 5 ml/minute. The column was washed until the absorbance at 280 nm was reduced to the baseline. The bound protein was eluted using a gradient of 0-250 mM imidazole in 50 mM Hepes pH 7.4, 500 mM sodium chloride. The fractions were analysed on 4-12% NuPAGE Bis-Tris polyacrylamide gels with coomassie staining.

Cleavage of the Fusion Partner and $His_6$-Tag

The purest fractions were pooled and dialysed against thrombin cleavage buffer (20 mM Tris/HCl pH 8.4+150 mM NaCl+2.5 mM Ca $Cl_2$) overnight at +4° C. Restriction grade thrombin (Novagen) was added at 1:2000 wt:wt with respect to the target protein. The mixture was incubated at room temperature overnight.

Immobilised Zinc Affinity Purification of Post Cleavage TxA4 Truncate

The protein solution (in 50 mM Hepes pH 7.4, 500 mM sodium chloride) was passed over a 24 ml zinc column (XK16×12) at a flow rate of 2 ml/minute. The column was washed with equilibration buffer (50 mM Hepes pH 7.4, 500 mM sodium chloride) until the absorbance at 280 nm was reduced to the baseline. The bound protein was eluted using a gradient of 0-250 mM imidazole in 50 mM Hepes pH 7.4, 500 mM sodium chloride.

Example 7—Formulation of Antigens of the Invention for Immunisation of Animals Purified *C. difficile* antigens at a concentration of between 0.5-2 mg/ml (nominally 1 mg/ml) were dialysed against a suitable buffer (e.g. 10 mM Hepes buffer pH 7.4 containing 150 mM NaCl) and then formaldehyde added to a final concentration of 0.2% and incubated for up to 7 days at 35° C. After incubation, the formaldehyde may optionally be removed by dialysis against a suitable buffer, e.g. phosphate buffered saline.

For sheep, 2 ml of buffer solution containing between 10 and 500 µg of the above *C. difficile* antigen is mixed with 2.6 ml of Freund's adjuvant to form an emulsion. Mixing with the adjuvant is carried out for several minutes to ensure a stable emulsion. The complete form of the adjuvant is used for the primary immunisation and incomplete Freund's adjuvant for all subsequent boosts.

Example 8—Generation of Antibodies to Antigens of the Invention

A number of conventional factors are taken into consideration during the preparation of antiserum in order to achieve the optimal humoral antibody response. These include: breed of animal; choice of adjuvant; number and location of immunisation sites; quantity of immunogen; and number of and interval between doses. With conventional optimisation of these parameters is routine to obtain specific antibody levels in excess of 6 g/liter of serum.

For sheep, an emulsion of the antigen with Freund's adjuvant was prepared as described as in Example 7. The complete form of the adjuvant is used for the primary immunisation and incomplete Freund's adjuvant for all subsequent boosts. About 4.2 ml of the antigen/adjuvant mixture was used to immunise each sheep by i.m. injection and spread across 6 sites including the neck and all the upper limbs. This was repeated every 28 days. Blood samples were taken 14 days after each immunisation.

For comparison of the toxin-neutralising immune response to the different antigens, 3 sheep were used per antigen. They were immunised as above using an identical protocol and the same protein dose per immunisation.

Example 9—Assessment of the Neutralising Efficacy of Antisera to Toxins Using the In Vitro Cell Assay The toxin neutralizing activity of the antisera against *C. difficile* Toxins was measured by cytotoxicity assays using Vero cells. A fixed amount of either purified *C. difficile* Toxin A or Toxin B was mixed with various dilutions of the antibodies, incubated for 30 min at 37° C. and then applied to Vero cells growing on 96-well tissue culture plates. Both Toxin A and B possess cytotoxic activity which results in a characteristic rounding of the Vero cells over a period of 24-72 h. In the presence of neutralising antibodies this activity is inhibited and the neutralising strength of an antibody preparation may be assessed by the dilution required to neutralise the effect of a designated quantity of either Toxin A or B.

Data demonstrating the neutralising activity of ovine antibody to various recombinant *C. difficile* Toxin B antigens are shown in Tables 3-6. In these experiments, various dilutions of ovine antibody were mixed with Toxin B at a final concentration of 0.5 ng/ml and incubated for 30 min at 37° C. and then applied to Vero cells as above and incubated at 37° and monitored over a period of 24-72 h. The antibody dilutions which completely protect the cells against the cytotoxic effects of the Toxin B were calculated. Similar data for Toxin A-derived antigens are shown in tables 7-10

Collectively, the data in Tables 3-10 show the superior capacity of fusion proteins of the invention to elicit a toxin-neutralising immune response compared to fragments containing just the repeat domains of either Toxin A or B.

Example 10—Assessment of the In Vivo Efficacy of Antiserum Generated Using Recombinant Antigens of the Invention for Treating CDI To demonstrate the efficacy of the antisera generated, using recombinant antigens, to treat CDI in vivo, Syrian hamsters are passively immunised with antibodies which have neutralising activity against one or more of the toxins of *C. difficile*. For assessing the efficacy of a treatment formulation, hamsters will be given antibody either intravenously or by the intraperitoneal route at various times from 6 hours post-challenge to 240 hours post challenge with *C. difficile*

Prior to passively immunisation hamsters are administered a broad spectrum antibiotic (e.g. clindamycin) and 12-72 h later challenged with *C. difficile* spores by mouth. Animals are then monitored for up to 15 days for symptoms of *C. difficile*-associated disease. Control, non-immunised animals develop signs of the disease (e.g. diarrhoea, swollen abdomen, lethargy, ruffled fur) while those treated with ovine antibody appear normal.

Example 11—Vaccination by Peptide/Peptide Fragments of the Invention

A vaccine, represented by a peptide/peptide fragment of the invention is prepared by current Good Manufacturing Practice. Using such practices, peptides/peptide fragments of the invention may be bound to an adjuvant of aluminium hydroxide which is commercially available (e.g. Alhydrogel). The vaccine would normally contain a combination of antigens of the invention derived from Toxin A and Toxin B but could also contain either Toxin A or B antigens. The vaccine may also contain Toxin A and B antigens in combination with other antigens of bacterial or viral origin.

Purified *C. difficile* Toxin A and/or Toxin B antigen of the invention may be treated with formaldehyde at a final concentration of 0.2% and incubated for up to 24 hours at 35° C. (as described in Example 7).

In addition to the antigens of the invention, a typical vaccine composition comprises:
A) A buffer (e.g., Hepes buffer between 5 and 20 mM and pH between 7.0 and 7.5;
B) A salt component to make the vaccine physiologically isotonic (e.g. between 100 and 150 mM NaCl);
C) An adjuvant (e.g., aluminium hydroxide at a final aluminium concentration of between 100 and 700 µg per vaccine dose); and
D) A preservative (e.g., Thiomersal at 0.01% or formaldehyde at 0.01%).

Such vaccine compositions are administered to humans by a variety of different immunisation regimens, such as:
1. A single dose (e.g., 20 µg adsorbed fragment of the invention) in 0.5 ml administered sub-cutaneously.
2. Two doses (e.g., of 10 µg adsorbed fragment of the invention) in 0.5 mls administered at 0 and 4 weeks.
3. Three doses (e.g., of 10 µg adsorbed fragment of the invention) in 0.5 mls administered at 0, 2 and 12 weeks.

These vaccination regimens confer levels of protection against exposure to the homologous serotypes of *C. difficile* toxins

Example 12—Affinity Purification of IgG Using Immobilised Constructs of the Invention Preparation of the Affinity Chromatography Medium The construct of the invention to be immobilised is dialysed against a suitable coupling buffer e.g. 0.1 M NaHCO$_3$ pH 8.3 containing 0.5 M NaCl. Approximately 5 ml of protein solution at 1-3 mg/ml is added per ml of CNBr-activated Sepharose 4B powder. The mixture is rotated end-over end for 1 h at room temperature or overnight at 4° C. Other gentle stirring methods may be employed. Excess ligand is then wash away excess with at least 5 medium (gel) volumes of coupling buffer. Any remaining active groups and then blocked. The medium is transferred to 0.1 M Tris-HCl buffer, pH 8.0 or 1 M ethanolamine, pH 8.0 and incubated 2 hours at room temperature. The gel is then washed with at least three cycles of alternating pH (at least 5 medium volumes of each buffer). Each cycle should consist of a wash with 0.1 M acetic acid/sodium acetate, pH 4.0 containing 0.5 M NaCl followed by a wash with. 0.1 M Tris-HCl, pH 8 containing 0.5 M NaCl. After washing the gel is transferred to a suitable storage buffer (e.g. 50 mM HEPES pH 7.4 containing 0.15M NaCl and stored at 4° C. until use Purification of IgG Affinity columns are prepared as above using antigens of the invention derived from either Toxin A or B. For purification of antibodies to Toxin B, a construct such as TxB4 (residues 767-2366) could be used. For purification of antibodies to Toxin A, a construct such as TxA4 (residues 770-2710) could be used. For affinity purification of antibodies which bind toxin B, serum which contains antibodies to Toxin B is diluted 1:1 with a suitable buffer (e.g. 20 mM HEPES pH 7.4 buffer containing 0.5M NaCl) and the mixture applied to column containing immobilised TxB4 packed in a suitable column (2-6 ml mixture per ml of gel). After the unbound fraction (which contains serum albumin and non-specific IgG) is washed off with at least 10 column volumes of 20 mM HEPES pH 7.4 buffer containing 0.5M NaCl buffer, the bound fraction is eluted from the column with 5 column volumes of elution buffer (e.g. 100 mM glycine buffer, pH 2.5). The eluted fractions containing the IgG are then immediately neutralised to approximately pH 7.0 with of 1M Tris-HCl pH 8.0. These fractions, which contain the IgG which binds Toxin B, are then dialysed against 50 mM HEPES pH 7.4 containing 0.15 m NaCl and stored frozen until required Affinity purified IgG fractions which bind and neutralises either Toxin A or B may be used as therapeutic agents to either treatment of prevent CD. They may also be used in assay systems such as enzyme-linked immunosorbant assay (ELISA) for the detection of Toxins A or B. In such diagnostic systems, affinity purified antibodies may provide assays of higher sensitivity and with reduced background interference.

FIGURES AND TABLES

TABLE 1

Toxin A Receptor-Binding Repeat Modules

| Toxin A Receptor-Binding Modules | Amino acid Sequence (Long Repeat regions shown in bold) |
|---|---|
| Module 1 LR = SEQ ID NO: 60 Module 1 (residues 1851-2007 = SEQ ID NO: 61) | GVFKGPDGFEYFAPANTQNNNIEGQAIVYQS<br>VTGWQTINGKKYYFDINTGAALTSYKIINGKHFYFNNDGVMQLGVFKGPDGFEYFAPANTQNNNIEGQAIVYQSKFLTLNGH YFDNNSKAVTGWRIINNEKYYFNPNNAIAAVGLQVIDNNKYYFNPDTAIISKGWQTVNGSRYYFDTDTAIAFN |
| Module 2 LR = SEQ ID NO: 62 Module 2 (residues 2008-2141 = SEQ ID NO: 63) | GVFSTSNGFEYFAPANTYNNNIEGQAIVYQS<br>GYKTIDGKHFYFDSDCVVKIGVFSTSNGFEYFAPANTYNNNIEGQAIVYQSKFLTLNGKKYYFDNNSKAVTGLQTIDSKKYY TNTAEAATGWQTIDGKKYYFNTNTAEAATGWQTIDGKKYYFNTNTAIAST |
| Module 3 LR = SEQ ID NO: 64 Module 3 (residues 2142-2253 = SEQ ID NO: 65) | GVFKGPNGFEYFAPANTDANNIEGQAILYQN<br>GYTIINGKHFYFNTDGIMQIGVFKGPNGFEYFAPANTDANNIEGQAILYQNEFLTLNGKKYYFGSDSKAVTGWRIINNKKYYF NNAIAAIHLCTINNDKYYFSYDGILQN |

TABLE 1-continued

Toxin A Receptor-Binding Repeat Modules

| Toxin A Receptor-Binding Modules | Amino acid Sequence (Long Repeat regions shown in bold) |
|---|---|
| Module 4 LR = SEQ ID NO: 66) Module 4 (residues 2254-2389 = SEQ ID NO: 67) | GVFKGPNGFEYFAPANTHNNNIEGQAIVYQN<br>GYITIERNNFYFDANNESKMVTGVFKGPNGFEYFAPANTHNNNIEGQAIVYQNKFLTLNGKKYYFDNDSKAVTGWQTIDGK YFNLNTAEAATGWQTIDGKKYYFNLNTAEAATGWQTIDGKKYYFNTNTFIAST |
| Module 5 LR = SEQ ID NO: 68) Module 5 (residues 2390-2502 = SEQ ID NO: 69) | GVFKGPNGFEYFAPANTDANNIEGQAILYQN<br>GYTSINGKHFYFNTDGIMQIGVFKGPNGFEYFAPANTDANNIEGQAILYQNKFLTLNGKKYYFGSDSKAVTGLRTIDGKKYY TNTAVAVTGWQTINGKKYYFNTNTSIAST |
| Module 6 LR = SEQ ID NO: 70) Module 6 (residues 2503-2594 = SEQ ID NO: 71) | GVFKGPDGFEYFAPANTDANNIEGQAIRYQN<br>GYTIISGKHFYFNTDGIMQIGVFKGPDGFEYFAPANTDANNIEGQAIRYQNRFLYLHDNIYYFGNNSKAATGWVTIDGNRYY PNTAMGAN |
| Module 7 LR = SEQ ID NO: 72) Module 7 (residues 2595-2710 = SEQ ID NO: 73) | GVFKGSNGFEYFAPANTDANNIEGQAIRYQN<br>GYKTIDNKNFYFRNGLPQIGVFKGSNGFEYFAPANTDANNIEGQAIRYQNRFLHLLGKIYYFGNNSKAVTGWQTINGKVYYI PDTAMAAAGGLFEIDGVIYFFGVDGVKAPGIYG |

TABLE 2

Toxin B Receptor-Binding Repeat Modules

| Toxin B Receptor-Binding Modules | Amino acid Sequence (Long Repeat regions shown in bold) |
|---|---|
| Module 1 LR = SEQ ID NO: 74 Module 1 (residues 1852-2007 = SEQ ID NO: 75) | GVFSTEDGFKYFAPANTLDENLEGEAIDFT<br>DDKYYFNPINGGAASIGETIIDDKNYYFNQSGVLQTGVFSTEDGFKYFAPANTLDENLEGEAIDFTGKLIIDE NIYYFDDNYRGAVEWKELDGEMHYFSPETGKAFKGLNQIGDYKYYFNSDGVMQKGFVSINDNKHYFDDS GVMKV |
| Module 2 LR = SEQ ID NO: 76 Module 2 (residues 2008-2139 = SEQ ID NO: 77) | GVFNTEDGFKYFAHHNEDLGNEEGEEISYS<br>GYTEIDGKHFYFAENGEMQIGVFNTEDGFKYFAHHNEDLGNEEGEEISYSGILNFNNKIYYFDDSFTAVVG WKDLEDGSKYYFDEDTAEAYIGLSLINDGQYYFNDDGIMQVGFVTINDKVFYFSDSGIIES |
| Module 3 LR = SEQ ID NO: 78 Module 3 (residues 2140-2273 = SEQ ID NO: 79) | GVFDTSDGYKYFAPANTVNDNIYGQAVEYS<br>GVQNIDDNYFYIDDNGIVQIGVFDTSDGYKYFAPANTVNDNIYGQAVEYSGLVRVGEDVYYFGETYTIETG WIYDMENESDKYYFNPETKKACKGINLIDDIKYYFDEKGIMRTGLISFENNNYYFNENGEMQF |
| Module 4 LR = SEQ ID NO: 80 Module 4 (residues 2274-2366 = SEQ ID NO: 81) | GVFNTPDGFKYFAHQNTLDENFEGESINYT<br>GYINIEDKMFYGEDGVMQIGVFNTPDGFKYFAHQNTLDENFEGESINYTGWLDLDEKRYYFTDEYIAATG SVIIDGEEYYFDPDTAQLVISE |

TABLE 3

Neutralisation titres obtained by immunisation of sheep with recombinant Toxin B-derived antigens (6 weeks time point; 2 doses of 100 µg each)

| Toxin B-derived Antigen (amino acid sequence) | Neutralisation titre against Toxin B (0.5 ng/ml) |
|---|---|
| Recombinant Toxin B (1756-2366) | <10 |
| Recombinant Toxin B (1145-2366) | 960 |
| Recombinant Toxin B (767-2366) | 2,560 |
| Recombinant Toxin B (543-2366) | 1,280 |

TABLE 4

Neutralisation titres obtained by immunisation of sheep with recombinant Toxin B-derived antigens (18 weeks time point; 5 doses of 100 µg each)

| Toxin B-derived Antigen (amino acid sequence) | Neutralisation titre against Toxin B (0.5 ng/ml) |
|---|---|
| Recombinant Toxin B (1756-2366) | 80 |
| Recombinant Toxin B (1145-2366) | 5,120 |
| Recombinant Toxin B (767-2366) | 10,250 |
| Recombinant Toxin B (543-2366) | 5,120 |

TABLE 5

Neutralisation titres obtained by immunisation of sheep with a recombinant Toxin B-derived antigen (TxB4; residues 767-2366) of the invention

| Antigen | No of Doses | Immunisation period (weeks) | Neutralisation titre against Toxin B (0.5 ng/ml) |
|---|---|---|---|
| Recombinant Toxin B (residues 767-2366) at 100 µg/dose | 2 | 6 | 2,560 |
| | 3 | 10 | 2,560 |
| | 4 | 14 | 10,250 |
| | 5 | 18 | 10,250 |
| | 6 | 22 | 20,480 |

TABLE 6

Neutralisation titres obtained by immunisation of sheep with a recombinant Toxin B-derived antigen (TxB2, 1756-2366) representing the repeat regions

| Antigen | No of Doses | Immunisation period (weeks) | Neutralisation titre against Toxin B (0.5 ng/ml) |
|---|---|---|---|
| Recombinant Toxin B (residues 1756-2366) at 100 µg/dose | 2 | 6 | <10 |
| | 3 | 10 | 10 |
| | 4 | 14 | 10 |
| | 5 | 18 | 80 |

TABLE 7

Neutralisation titres obtained by immunisation of sheep with recombinant Toxin A-derived antigens (10 weeks time point)

| Toxin A-derived Antigen (amino acid sequence) | No of Doses (100 µg) | Neutralisation titre against Toxin A (50 ng/ml) |
|---|---|---|
| Recombinant Toxin A (1850-2710) | 3 | 640 |
| Recombinant Toxin A (770-2710) | 2 | 7,680 |
| Recombinant Toxin A (770-2389) | 3 | 10,240 |

TABLE 8

Neutralisation titres obtained by immunisation of sheep with recombinant Toxin A-derived antigens (18 weeks time point)

| Toxin A-derived Antigen (amino acid sequence) | No of Doses (100 µg) | Neutralisation titre against Toxin A (50 ng/ml) |
|---|---|---|
| Recombinant Toxin A (1850-2710) | 5 | 1,280 |
| Recombinant Toxin A (770-2710) | 4 | 15,360 |

TABLE 9

Neutralisation titres obtained by immunisation of sheep with a recombinant Toxin A-derived antigen (TxA4; residues 770-2710) of the invention

| Antigen | No of Doses | Immunisation period (weeks) | Neutralisation titre against Toxin A (50 ng/ml) |
|---|---|---|---|
| Recombinant Toxin A (residues 770-2710) at 100 µg/dose | 2 | 10 | 7,680 |
| | 3 | 14 | 10,240 |
| | 4 | 18 | 15,360 |

TABLE 10

Neutralisation titres obtained by immunisation of sheep with a recombinant Toxin A-derived antigen (TxA2; residues 1850-2710) representing the repeat region only

| Antigen | No of Doses | Immunisation period (weeks) | Neutralisation titre against Toxin A (50 ng/ml) |
|---|---|---|---|
| Recombinant Toxin A (residues 1850-2710) at 100 µg/dose | 2 | 6 | 320 |
| | 3 | 10 | 630 |
| | 4 | 14 | 1,280 |
| | 5 | 18 | 1,280 |

SED ID NOs

```
Clostridium difficile Toxin A (Toxinotype 0)
                                                                  SEQ ID NO: 1
MSLISKEELIKLAYSIRPRENEYKTILTNLDEYNKLTTNNNENKYLQLKKLNESIDVFMNKYKTSSRNRA

LSNLKKDILKEVILIKNSNTSPVEKNLHFVWIGGEVSDIALEYIKQWADINAEYNIKLWYDSEAFLVNTLK

KAIVESSTTEALQLLEEEIQNPQFDNMKFYKKRMEFIYDRQKRFINYYKSQINKPTVPTIDDIIKSHLVSE

YNRDETVLESYRTNSLRKINSNHGIDIRANSLFTEQELLNIYSQELLNRGNLAAASDIVRLLALKNFGGV

YLDVDMLPGIHSDLFKTISRPSSIGLDRWEMIKLEAIMKYKKYINNYTSENFDKLDQQLKDNFKLIIESKS

EKSEIFSKLENLNVSDLEIKIAFALGSVINQALISKQGSYLTNLVIEQVKNRYQFLNQHLNPAIESDNNFT

DTTKIFHDSLFNSATAENSMFLTKIAPYLQVGFMPEARSTISLSGPGAYASAYYDFINLQENTIEKTLKA

SDLIEFKFPENNLSQLTEQEINSLWSFDQASAKYQFEKYVRDYTGGSLSEDNGVDFNKNTALDKNYLL

NNKIPSNNVEEAGSKNYVHYIIQLQGDDISYEATCNLFSKNPKNSIIIQRNMNESAKSYFLSDDGESILE

LNKYRIPERLKNKEKVKVTFIGHGKDEFNTSEFARLSVDSLSNEISSFLDTIKLDISPKNVEVNLLGCNM

FSYDFNVEETYPGKLLLSIMDKITSTLPDVNKNSITIGANQYEVRINSEGRKELLAHSGKWINKEEAIMS

DLSSKEYIFFDSIDNKLKAKSKNIPGLASISEDIKTLLLDASVSPDTKFILNNLKLNIESSIGDYIYYEKLEP

VKNIIHNSIDDLIDEFNLLENVSDELYELKKLNNLDEKYLISFEDISKNNSTYSVRFINKSNGESVYVETE
```

-continued

KEIFSKYSEHITKEISTIKNSIITDVNGNLLDNIQLDHTSQVNTLNAAFFIQSLIDYSSNKDVLNDLSTSVK

VQLYAQLFSTGLNTIYDSIQLVNLISNAVNDTINVLPTITEGIPIVSTILDGINLGAAIKELLDEHDPLLKKEL

EAKVGVLAINMSLSIAATVASIVGIGAEVTIFLLPIAGISAGIPSLVNNELILHDKATSVVNYFNHLSESKK

YGPLKTEDDKILVPIDDLVISEIDFNNNSIKLGTCNILAMEGGSGHTVTGNIDHFFSSPSISSHIPSLSIYS

AIGIETENLDFSKKIMMLPNAPSRVFWWETGAVPGLRSLENDGTRLLDSIRDLYPGKFYWRFYAFFDY

AITTLKPVYEDTNIKIKLDKDTRNFIMPTITTNEIRNKLSYSFDGAGGTYSLLLSSYPISTNINLSKDDLWI

FNIDNEVREISIENGTIKKGKLIKDVLSKIDINKNKLIIGNQTIDFSGDIDNKDRYIFLTCELDDKISLIIEINLV

AKSYSLLLSGDKNYLISNLSNTIEKINTLGLDSKNIAYNYTDESNNKYFGAISKTSQKSIIHYKKDSKNILE

FYNDSTLEFNSKDFIAEDINVFMKDDINTITGKYYVDNNTDKSIDFSISLVSKNQVKVNGLYLNESVYSS

YLDFVKNSDGHHNTSNFMNLFLDNISFWKLFGFENINFVIDKYFTLVGKTNLGYVEFICDNNKNIDIYFG

EWKTSSSKSTIFSGNGRNVVVEPIYNPDTGEDISTSLDFSYEPLYGIDRYINKVLIAPDLYTSLININTNY

YSNEYYPEIIVLNPNTFHKKVNINLDSSSFEYKWSTEGSDFILVRYLEESNKKILQKIRIKGILSNTQSFN

KMSIDFKDIKKLSLGYIMSNFKSFNSENELDRDHLGFKIIDNKTYYYDEDSKLVKGLININNSLFYFDPIE

FNLVTGWQTINGKKYYFDINTGAALTSYKIINGKHFYFNNDGVMQLGVFKGPDGFEYFAPANTQNNNI

EGQAIVYQSKFLTLNGKKYYFDNNSKAVTGWRIINNEKYYFNPNNAIAAVGLQVIDNNKYYFNPDTAIIS

KGWQTVNGSRYYFDTDTAIAFNGYKTIDGKHFYFDSDCVVKIGVFSTSNGFEYFAPANTYNNNIEGQ

AIVYQSKFLTLNGKKYYFDNNSKAVTGLQTIDSKKYYFNTNTAEAATGWQTIDGKKYYFNTNTAEAAT

GWQTIDGKKYYFNTNTAIASTGYTIINGKHFYFNTDGIMQIGVFKGPNGFEYFAPANTDANNIEGQAIL

YQNEFLTLNGKKYYFGSDSKAVTGWRIINNKKYYFNPNNAIAAIHLCTINNDKYYFSYDGILQNGYITIE

RNNFYFDANNESKMVTGVFKGPNGFEYFAPANTHNNNIEGQAIVYQNKFLTLNGKKYYFDNDSKAVT

GWQTIDGKKYYFNLNTAEAATGWQTIDGKKYYFNLNTAEAATGWQTIDGKKYYFNTNTFIASTGYTSI

NGKHFYFNTDGIMQIGVFKGPNGFEYFAPANTDANNIEGQAILYQNKFLTLNGKKYYFGSDSKAVTGL

RTIDGKKYYFNTNTAVAVTGWQTINGKKYYFNTNTSIASTGYTIISGKHFYFNTDGIMQIGVFKGPDGF

EYFAPANTDANNIEGQAIRYQNRFLYLHDNIYYFGNNSKAATGWVTIDGNRYYFEPNTAMGANGYKTI

DKNFYFRNGLPQIGVFKGSNGFEYFAPANTDANNIEGQAIRYQNRFLHLLGKIYYFGNNSKAVTGW

QTINGKVYYFMPDTAMAAAGGLFEIDGVIYFFGVDGVKAPGIYG

*C. difficile* Toxin B (Toxinotype 0)
SEQ ID NO: 2

MSLVNRKQLEKMANVRFRTQEDEYVAILDALEEYHNMSENTVVEKYLKLKDINSLTDIYIDTYKKSGRN

KALKKFKEYLVTEVLELKNNNLTPVEKNLHFVWIGGQINDTAINYINQWKDVNSDYNVNVFYDSNAFLI

NTLKKTVVESAINDTLESFRENLNDPRFDYNKFFRKRMEIIYDKQKNFINYYKAQREENPELIIDDIVKTY

LSNEYSKEIDELNTYIEESLNKITQNSGNDVRNFEEFKNGESFNLYEQELVERWNLAAASDILRISALKE

IGGMYLDVDMLPGIQPDLFESIEKPSSVTVDFWEMTKLEAIMKYKEYIPEYTSEHFDMLDEEVQSSFE

SVLASKSDKSEIFSSLGDMEASPLEVKIAFNSKGIINQGLISVKDSYCSNLIVKQIENRYKILNNSLNPAIS

EDNDFNTTTNTFIDSIMAEANADNGRFMMELGKYLRVGFFPDVKTTINLSGPEAYAAAYQDLLMFKEG

SMNIHLIEADLRNFEISKTNISQSTEQEMASLWSFDDARAKAQFEEYKRNYFEGSLGEDDNLDFSQNI

VVDKEYLLEKISSLARSSERGYIHYIVQLQGDKISYEAACNLFAKTPYDSVLFQKNIEDSEIAYYYNPGD

GEIQEIDKYKIPSIISDRPKIKLTFIGHGKDEFNTDIFAGFDVDSLSTEIEAAIDLAKEDISPKSIEINLLGCN

MFSYSINVEETYPGKLLLKVKDKISELMPSISQDSIIVSANQYEVRINSEGRRELLDHSGEWINKEESIIK

DISSKEYISFNPKENKITVKSKNLPELSTLLQEIRNNSNSSDIELEEKVMLTECEINVISNIDTQIVEERIEE

AKNLTSDSINYIKDEFKLIESISDALCDLKQQNELEDSHFISFEDISETDEGFSIRFINKETGESIFVETEK

TIFSEYANHITEEISKIKGTIFDTVNGKLVKKVNLDTTHEVNTLNAAFFIQSLIEYNSSKESLSNLSVAMKV

-continued

QVYAQLFSTGLNTITDAAKVVELVSTALDETIDLLPTLSEGLPIIATIIDGVSLGAAIKELSETSDPLLRQEI

EAKIGIMAVNLTTATTAIITSSLGIASGFSILLVPLAGISAGIPSLVNNELVLRDKATKVVDYFKHVSLVET

EGVFTLLDDKIMMPQDDLVISEIDFNNNSIVLGKCEIWRMEGGSGHTVTDDIDHFFSAPSITYREPHLSI

YDVLEVQKEELDLSKDLMVLPNAPNRVFAWETGWTPGLRSLENDGTKLLDRIRDNYEGEFYWRYFA

FIADALITTLKPRYEDTNIRINLDSNTRSFIVPIITTEYIREKLSYSFYGSGGTYALSLSQYNMGINIELSES

DVWIIDVDNVVRDVTIESDKIKKGDLIEGILSTLSIEENKIILNSHEINFSGEVNGSNGFVSLTFSILEGINAI

IEVDLLSKSYKLLISGELKILMLNSNHIQQKIDYIGFNSELQKNIPYSFVDSEGKENGFINGSTKEGLFVS

ELPDVVLISKVYMDDSKPSFGYYSNNLKDVKVITKDNVNILTGYYLKDDIKISLSLTLQDEKTIKLNSVHL

DESGVAEILKFMNRKGNTNTSDSLMSFLESMNIKSIFVNFLQSNIKFILDANFIISGTTSIGQFEFICDEN

DNIQPYFIKFNTLETNYTLYVGNRQNMIVEPNYDLDDSGDISSTVINFSQKYLYGIDSCVNKVVISPNIYT

DEINITPVYETNNTYPEVIVLDANYINEKINVNINDLSIRYVWSNDGNDFILMSTSEENKVSQVKIRFVNV

FKDKTLANKLSFNFSDKQDVPVSEIILSFTPSYYEDGLIGYDLGLVSLYNEKFYINNFGMMVSGLIYIND

SLYYFKPPVNNLITGFVTVGD

DKYYFNPINGGAASIGETIIDDKNYYFNQSGVLQTGVFSTEDGFKYFAPANTLDENLEGEAIDFTGKLII

DENIYYFDDNYRGAVEWKELDGEMHYFSPETGKAFKGLNQIGDYKYYFNSDGVMQKGFVSINDNKH

YFDDSGVMKVGYTEIDGKHFYFAENGEMQIGVFNTEDGFKYFAHHNEDLGNEEGEEISYSGILNFNN

KIYYFDDSFTAVVGWKDLEDGSKYYFDEDTAEAYIGLSLINDGQYYFNDDGIMQVGFVTINDKVFYFS

DSGIIESGVQNIDDNYFYIDDNGIVQIGVFDTSDGYKYFAPANTVNDNIYGQAVEYSGLVRVGEDVYYF

GETYTIETGWIYDMENESDKYYFNPETKKACKGINLIDDIKYYFDEKGIMRTGLISFENNNYYFNENGE

MQFGYINIEDKMFYFGEDGVMQIGVFNTPDGFKYFAHQNTLDENFEGESINYTGWLDLDEKRYYFTD

EYIAATGSVIIDGEEYYFDPDTAQLVISE

C. difficile Toxin A (Toxinotype 3)                                                    SEQ ID NO: 3

MSLISKEELIKLAYSIRPRENEYKTILTNLDEYNKLTTNNNENKYLQLKKLNESIDVFMNKYKNSSRNRA

LSNLKKDILKEVILIKNSNTSPVEKNLHFVWIGGEVSDIALEYIKQWADINAEYNIKLWYDSEAFLVNTLK

KAIVESSTTEALQLLEEEIQNPQFDNMKFYKKRMEFIYDRQKRFINYYKSQINKPTVPTIDDIIKSHLVSE

YNRDETLLESYRTNSLRKINSNHGIDIRANSLFTEQELLNIYSQELLNRGNLAAASDIVRLLALKNFGGV

YLDVDMLPGIHSDLFKTIPRPSSIGLDRWEMIKLEAIMKYKKYINNYTSENFDKLDQQLKDNFKLIIESKS

EKSEIFSKLENLNVSDLEIKIAFALGSVINQALISKQGSYLTNLVIEQVKNRYQFLNQHLNPAIESDNNFT

DTTKIFHDSLFNSATAENSMFLTKIAPYLQVGFMPEARSTISLSGPGAYASAYYDFINLQENTIEKTLKA

SDLIEFKFPENNLSQLTEQEINSLWSFDQASAKYQFEKYVRDYTGGSLSEDNGVDFNKNTALDKNYLL

NNKIPSNNVEEAGSKNYVHYIIQLQGDDISYEATCNLFSKNPKNSIIIQRNMNESAKSYFLSDDGESILE

LNKYRIPERLKNKEKVKVTFIGHGKDEFNTSEFARLSVDSLSNEISSFLDTIKLDISPKNVEVNLLGCNM

FSYDFNVEETYPGKLLLSIMDKITSTLPDVNKDSITIGANQYEVRINSEGRKELLAHSGKWINKEEAIMS

DLSSKEYIFFDSIDNKLKAKSKNIPGLASISEDIKTLLLDASVSPDTKFILNNLKLNIESSIGDYIYYEKLEP

VKNIIHNSIDDLIDEFNLLENVSDELYELKKLNNLDEKYLISFEDISKNNSTYSVRFINKSNGESVYVETE

KEIFSKYSEHITKEISTIKNSIITDVNGNLLDNIQLDHTSQVNTLNAAFFIQSLIDYSSNKDVLNDLSTSVK

VQLYAQLFSTGLNTIYDSIQLVNLISNAVNDTINVLPTITEGIPIVSTILDGINLGAAIKELLDEHDPLLKKEL

EAKVGVLAINMSLSIAATVASIVGIGAEVTIFLLPIAGISAGIPSLVNNELILHDKATSVVNYFNHLSESKE

YGPLKTEDDKILVPIDDLVISEIDFNNNSIKLGTCNILAMEGGSGHTVTGNIDHFFSSPYISSHIPSLSVYS

AIGIKTENLDFSKKIMMLPNAPSRVFWWETGAVPGLRSLENNGTKLLDSIRDLYPGKFYWRFYAFFDY

-continued

AITTLKPVYEDTNTKIKLDKDTRNFIMPTITTDEIRNKLSYSFDGAGGTYSLLLSSYPISMNINLSKDDLWI

FNIDNEVREISIENGTIKKGNLIEDVLSKIDINKNKLIIGNQTIDFSGDIDNKDRYIFLTCELDDKISLIIEINLV

AKSYSLLLSGDKNYLISNLSNTIEKINTLGLDSKNIAYNYTDESNNKYFGAISKTSQKSIIHYKKDSKNILE

FYNGSTLEFNSKDFIAEDINVFMKDDINTITGKYYVDNNTDKSIDFSISLVSKNQVKVNGLYLNESVYSS

YLDFVKNSDGHHNTSNFMNLFLNNISFWKLFGFENINFVIDKYFTLVGKTNLGYVEFICDNNKNIDIYFG

EWKTSSSKSTIFSGNGRNVVVEPIYNPDTGEDISTSLDFSYEPLYGIDRYINKVLIAPDLYTSLININTNY

YSNEYYPEIIVLNPNTFHKKVNINLDSSSFEYKWSTEGSDFILVRYLEESNKKILQKIRIKGILSNTQSFN

KMSIDFKDIKKLSLGYIMSNFKSFNSENELDRDHLGFKIIDNKTYYYDEDSKLVKGLININNSLFYFDPIE

SNLVTGWQTINGKKYYFDINTGAASTSYKIINGKHFYFNNNGVMQLGVFKGPDGFEYFAPANTQNNNI

EGQAIVYQSKFLTLNGKKYYFDNDSKAVTGWRIINNEKYYFNPNNAIAAVGLQVIDNNKYYFNPDTAIIS

KGWQTVNGSRYYFDTDTAIAFNGYKTIDGKHFYFDSDCVVKIGVFSGSNGFEYFAPANTYNNNIEGQ

AIVYQSKFLTLNGKKYYFDNNSKAVTGWQTIDSKKYYFNTNTAEAATGWQTIDGKKYYFNTNTAEAAT

GWQTIDGKKYYFNTNTSIASTGYTIINGKYFYFNTDGIMQIGVFKVPNGFEYFAPANTHNNNIEGQAILY

QNKFLTLNGKKYYFGSDSKAITGWQTIDGKKYYFNPNNAIAATHLCTINNDKYYFSYDGILQNGYITIER

NNFYFDANNESKMVTGVFKGPNGFEYFAPANTHNNNIEGQAIVYQNKFLTLNGKKYYFDNDSKAVTG

WQTIDSKKYYFNLNTAVAVTGWQTIDGEKYYFNLNTAEAATGWQTIDGKRYYFNTNTYIASTGYTIING

KHFYFNTDGIMQIGVFKGPDGFEYFAPANTHNNNIEGQAILYQNKFLTLNGKKYYFGSDSKAVTGLRTI

DGKKYYFNTNTAVAVTGWQTINGKKYYFNTNTYIASTGYTIISGKHFYFNTDGIMQIGVFKGPDGFEYF

APANTDANNIEGQAIRYQNRFLYLHDNIYYFGNDSKAATGWATIDGNRYYFEPNTAMGANGYKTIDNK

NFYFRNGLPQIGVFKGPNGFEYFAPANTDANNIDGQAIRYQNRFLHLLGKIYYFGNNSKAVTGWQTIN

SKVYYFMPDTAMAAAGGLFEIDGVIYFFGVDGVKAPGIYG

C. difficile Toxin B (Toxinotype 3)                                                  SEQ ID NO: 4

MSLVNRKQLEKMANVRFRVQEDEYVAILDALEEYHNMSENTVVEKYLKLKDINSLTDIYIDTYKKSGR

NKALKKFKEYLVTEVLELKNNNLTPVEKNLHFVWIGGQINDTAINYINQWKDVNSDYNVNVFYDSNAF

LINTLKKTIVESATNDTLESFRENLNDPRFDYNKFYRKRMEIIYDKQKNFINYYKTQREENPDLIIDDIVKI

YLSNEYSKDIDELNSYIEESLNKVTENSGNDVRNFEEFKGGESFKLYEQELVERWNLAAASDILRISAL

KEVGGVYLDVDMLPGIQPDLFESIEKPSSVTVDFWEMVKLEAIMKYKEYIPGYTSEHFDMLDEEVQSS

FESVLASKSDKSEIFSSLGDMEASPLEVKIAFNSKGIINQGLISVKDSYCSNLIVKQIENRYKILNNSLNP

AISEDNDFNTTTNAFIDSIMAEANADNGRFMMELGKYLRVGFFPDVKTTINLSGPEAYAAAYQDLLMF

KEGSMNIHLIEADLRNFEISKTNISQSTEQEMASLWSFDDARAKAQFEEYKKNYFEGSLGEDDNLDFS

QNTVVDKEYLLEKISSLARSSERGYIHYIVQLQGDKISYEAACNLFAKTPYDSVLFQKNIEDSEIAYYYN

PGDGEIQEIDKYKIPSIISDRPKIKLTFIGHGKDEFNTDIFAGLDVDSLSTEIETAIDLAKEDISPKSIEINLL

GCNMFSYSVNVEETYPGKLLLRVKDKVSELMPSISQDSIIVSANQYEVRINSEGRRELLDHSGEWINK

EESIIKDISSKEYISFNPKENKIIVKSKNLPELSTLLQEIRNNSNSSDIELEEKVMLAECEINVISNIDTQVV

EGRIEEAKSLTSDSINYIKNEFKLIESISDALYDLKQQNELEESHFISFEDILETDEGFSIRFIDKETGESIF

VETEKAIFSEYANHITEEISKIKGTIFDTVNGKLVKKVNLDATHEVNTLNAAFFIQSLIEYNSSKESLSNLS

VAMKVQVYAQLFSTGLNTITDAAKVVELVSTALDETIDLLPTLSEGLPVIATIIDGVSLGAAIKELSETSD

PLLRQEIEAKIGIMAVNLTAATTAIITSSLGIASGFSILLVPLAGISAGIPSLVNNELILRDKATKVVDYFSHI

SLAESEGAFTSLDDKIMMPQDDLVISEIDFNNNSITLGKCEIWRMEGGSGHTVTDDIDHFFSAPSITYR

EPHLSIYDVLEVQKEELDLSKDLMVLPNAPNRVFAWETGWTPGLRSLENDGTKLLDRIRDNYEGEFY

WRYFAFIADALITTLKPRYEDTNIRINLDSNTRSFIVPVITTEYIREKLSYSFYGSGGTYALSLSQYNMNI

-continued

NIELNENDTWVIDVDNVVRDVTIESDKIKKGDLIENILSKLSIEDNKIILDNHEINFSGTLNGGNGFVSLTF

SILEGINAVIEVDLLSKSYKVLISGELKTLMANSNSVQQKIDYIGLNSELQKNIPYSFMDDKGKENGFINC

STKEGLFVSELSDVVLISKVYMDNSKPLFGYCSNDLKDVKVITKDDVIILTGYYLKDDIKISLSFTIQDEN

TIKLNGVYLDENGVAEILKFMNKKGSTNTSDSLMSFLESMNIKSIFINSLQSNTKLILDTNFIISGTTSIGQ

FEFICDKDNNIQPYFIKFNTLETKYTLYVGNRQNMIVEPNYDLDDSGDISSTVINFSQKYLYGIDSCVNK

VIISPNIYTDEINITPIYEANNTYPEVIVLDTNYISEKININDLSIRYVWSNDGSDFILMSTDEENKVSQV

KIRFTNVFKGNTISDKISFNFSDKQDVSINKVISTFTPSYYVEGLLNYDLGLISLYNEKFYINNFGMMVS

GLVYINDSLYYFKPPIKNLITGFTTIGDDKYYFNPDNGGAASVGETIIDGKNYYFSQNGVLQTGVFSTE

DGFKYFAPADTLDENLEGEAIDFTGKLTIDENVYYFGDNYRAAIEWQTLDDEVYYFSTDTGRAFKGLN

QIGDDKFYFNSDGIMQKGFVNINDKTFYFDDSGVMKSGYTEIDGKYFYFAENGEMQIGVFNTADGFK

YFAHHDEDLGNEEGEALSYSGILNFNNKIYYFDDSFTAVVGWKDLEDGSKYYFDEDTAEAYIGISIIND

GKYYFNDSGIMQIGFVTINNEVFYFSDSGIVESGMQNIDDNYFYIDENGLVQIGVFDTSDGYKYFAPAN

TVNDNIYGQAVEYSGLVRVGEDVYYFGETYTIETGWIYDMENESDKYYFDPETKKAYKGINVIDDIKYY

FDENGIMRTGLITFEDNHYYFNEDGIMQYGYLNIEDKTFYFSEDGIMQIGVFNTPDGFKYFAHQNTLDE

NFEGESINYTGWLDLDEKRYYFTDEYIAATGSVIIDGEEYYFDPDTAQLVISE

Toxin A fragment - TxA3 (Toxinotype 0) (Residues 1131-2710)
SEQ ID 5

ESKKYGPLKTEDDKILVPIDDLVISEIDFNNNSIKLGTCNILAMEGGSGHTVTGNIDHFFSSPSISSHIPSL

SIYSAIGIETENLDFSKKIMMLPNAPSRVFWWETGAVPGLRSLENDGTRLLDSIRDLYPGKFYWRFYA

FFDYAITTLKPVYEDTNIKIKLDKDTRNFIMPTITTNEIRNKLSYSFDGAGGTYSLLLSSYPISTNINLSKD

DLWIFNIDNEVREISIENGTIKKGKLIKDVLSKIDINKNKLIIGNQTIDFSGDIDNKDRYIFLTCELDDKISLII

EINLVAKSYSLLLSGDKNYLISNLSNIIEKINTLGLDSKNIAYNYTDESNNKYFGAISKTSQKSIIHYKKDS

KNILEFYNDSTLEFNSKDFIAEDINVFMKDDINTITGKYYVDNNTDKSIDFSISLVSKNQVKVNGLYLNES

VYSSYLDFVKNSDGHHNTSNFMNLFLDNISFWKLFGFENINFVIDKYFTLVGKTNLGYVEFICDNNKNI

DIYFGEWKTSSSKSTIFSGNGRNVVVEPIYNPDTGEDISTSLDFSYEPLYGIDRYINKVLIAPDLYTSLINI

NTNYYSNEYYPEIIVLNPNTFHKKVNINLDSSSFEYKWSTEGSDFILVRYLEESNKKILQKIRIKGILSNT

QSFNKMSIDFKDIKKLSLGYIMSNFKSFNSENELDRDHLGFKIIDNKTYYYDEDSKLVKGLININNSLFYF

DPIEFNLVTGWQTINGKKYYFDINTGAALISYKIINGKHFYFNNDGVMQLGVFKGPDGFEYFAPANTQN

NNIEGQAIVYQSKFLTLNGKKYYFDNDSKAVTGWRIINNEKYYFNPNNAIAAVGLQVIDNNKYYFNPDT

AIISKGWQTVNGSRYYFDTDTAIAFNGYKTIDGKHFYFDSDCVVKIGVFSTSNGFEYFAPANTYNNNIE

GQAIVYQSKFLTLNGKKYYFDNNSKAVTGWQTIDSKKYYFNTNTAEAATGWQTIDGKKYYFNTNTAE

AATGWQTIDGKKYYFNTNTAIASTGYTIINGKHFYFNTDGIMQIGVFKGPNGFEYFAPANTDANNIEGQ

AILYQNEFLTLNGKKYYFGSDSKAVTGWRIINNKKYYFNPNNAIAAIHLCTINNDKYYFSYDGILQNGYI

TIERNNFYFDANNESKMVTGVFKGPNGFEYFAPANTHNNNIEGQAIVYQNKFLTLNGKKYYFDNDSK

AVTGWQTIDGKKYYFNLNTAEAATGWQTIDKKYYFNLNTAEAATGWQTIDGKKYYFNTNTFIASTG

YTSINGKHFYFNTDGIMQIGVFKGPNGFEYFAPANTHNNNIEGQAILYQNKFLTLNGKKYYFGSDSKA

VTGLRTIDGKKYYFNTNTAVAVTGWQTINGKKYYFNTNTSIASTGYTIISGKHFYFNTDGIMQIGVFKG

PDGFEYFAPANTDANNIEGQAIRYQNRFLYLHDNIYYFGNNSKAATGWVTIDGNRYYFEPNTAMGAN

GYKTIDNKNFYFRNGLPQIGVFKGSNGFEYFAPANTDANNIEGQAIRYQNRFLHLLGKIYYFGNNSKA

VTGWQTINGKVYYFMPDTAMAAAGGLFEIDGVIYFFGVDGVKAPGIYG

-continued

Toxin A fragment - TxA3 (Toxinotype 3) (Residues 1131-2710)  SEQ ID 6

ESKKYGPLKTEDDKILVPIDDLVISEIDFNNNSIKLGTCNILAMEGGSGHTVTGNIDHFFSSPSISSHIPSL
SIYSAIGIETENLDFSKKIMMLPNAPSRVFWWETGAVPGLRSLENDGTRLLDSIRDLYPGKFYWRFYA
FFDYAITTLKPVYEDTNIKIKLDKDTRNFIMPTITTNEIRNKLSYSFDGAGGTYSLLLSSYPISTNINLSKD
DLWIFNIDNEVREISIENGTIKKGKLIKDVLSKIDINKNKLIIGNQTIDFSGDIDNKDRYIFLTCELDDKISLII
EINLVAKSYSLLLSGDKNYLISNLSNTIEKINTLGLDSKNIAYNYTDESNNKYFGAISKTSQKSIIHYKKDS
KNILEFYNDSTLEFNSKDFIAEDINVFMKDDINTITGKYYVDNNTDKSIDFSISLVSKNQVKVNGLYLNES
VYSSYLDFVKNSDGHHNTSNFMNLFLDNISFWKLFGFENINFVIDKYFTLVGKTNLGYVEFICDNNKNI
DIYFGEWKTSSSKSTIFSGNGRNVVVEPIYNPDTGEDISTSLDFSYEPLYGIDRYINKVLIAPDLYTSLINI
NTNYYSNEYYPEIIVLNPNTFHKKVNINLDSSSFEYKWSTEGSDFILVRYLEESNKKILQKIRIKGILSNT
QSFNKMSIDFKDIKKLSLGYIMSNFKSFNSENELDRDHLGFKIIDNKTYYYDEDSKLVKGLININNSLFYF
DPIEFNLVTGWQTINGKKYYFDINTGAALTSYKIINGKHFYFNNDGVMQLGVFKGPDGFEYFAPANTQ
NNNIEGQAIVYQSKFLTLNGKKYYFDNNSKAVTGWRIINNEKYYFNPNNAIAAVGLQVIDNNKYYFNPD
TAIISKGWQTVNGSRYYFDTDTAIAFNGYKTIDGKHFYFDSDCVVKIGVFSTSNGFEYFAPANTYNNNI
EGQAIVYQSKFLTLNGKKYYFDNNSKAVTGLQTIDSKKYYFNTNTAEAATGWQTIDGKKYYFNTNTAE
AATGWQTIDGKKYYFNTNTAIASTGYTIINGKHFYFNTDGIMQIGVFKGPNGFEYFAPANTDANNIEGQ
AILYQNEFLTLNGKKYYFGSDSKAVTGWRIINNKKYYFNPNNAIAAIHLCTINNDKYYFSYDGILQNGYI
TIERNNFYFDANNESKMVTGVFKGPNGFEYFAPANTHNNNIEGQAIVYQNKFLTLNGKKYYFDNDSK
AVTGWQTIDGKKYYFNLNTAEAATGWQTIDGKKYYFNLNTAEAATGWQTIDGKKYYFNTNTFIASTG
YTSINGKHFYFNTDGIMQIGVFKGPNGFEYFAPANTDANNIEGQAILYQNKFLTLNGKKYYFGSDSKA
VTGLRTIDGKKYYFNTNTAVAVTGWQTINGKKYYFNTNTSIASTGYTIISGKHFYFNTDGIMQIGVFKG
PDGFEYFAPANTDANNIEGQAIRYQNRFLYLHDNIYYFGNNSKAATGWVTIDGNRYYFEPNTAMGAN
GYKTIDNKNFYFRNGLPQIGVFKGSNGFEYFAPANTDANNIEGQAIRYQNRFLHLLGKIYYFGNNSKA
VTGWQTINGKVYYFMPDTAMAAAGGLFEIDGVIYFFGVDGVKAPGIYG

Toxin A fragment - TxA4 (Toxinotype 0) (Residues 770-2710)  SEQ ID 7

IMSDLSSKEYIFFDSIDNKLKAKSKNIPGLASISEDIKTLLLDASVSPDTKFILNNLKLNIESSIGDYIYYEKL
EPVKNIIHNSIDDLIDEFNLLENVSDELYELKKLNNLDEKYLISFEDISKNNSTYSVRFINKSNGESVYVE
TEKEIFSKYSEHITKEISTIKNSIITDVNGNLLDNIQLDHTSQVNTLNAAFFIQSLIDYSSNKDVLNDLSTS
VKVQLYAQLFSTGLNTIYDSIQLVNLISNAVNDTINVLPTITEGIPIVSTILDGINLGAAIKELLDEHDPLLK
KELEAKVGVLAINMSLSIAATVASIVGIGAEVTIFLLPIAGISAGIPSLVNNELILHDKATSVVNYFNHLSES
KKYGPLKTEDDKILVPIDDLVISEIDFNNNSIKLGTCNILAMEGGSGHTVTGNIDHFFSSPSISSHIPSLSI
YSAIGIETENLDFSKKIMMLPNAPSRVFWWETGAVPGLRSLENDGTRLLDSIRDLYPGKFYWRFYAFF
DYAITTLKPVYEDTNIKIKLDKDTRNFIMPTITTNEIRNKLSYSFDGAGGTYSLLLSSYPISTNINLSKDDL
WIFNIDNEVREISIENGTIKKGKLIKDVLSKIDINKNKLIIGNQTIDFSGDIDNKDRYIFLTCELDDKISLIIEIN
LVAKSYSLLLSGDKNYLISNLSNIIEKINTLGLDSKNIAYNYTDESNNKYFGAISKTSQKSIIHYKKDSKNI
LEFYNDSTLEFNSKDFIAEDINVFMKDDINTITGKYYVDNNTDKSIDFSISLVSKNQVKVNGLYLNESVY
SSYLDFVKNSDGHHNTSNFMNLFLDNISFWKLFGFENINFVIDKYFTLVGKTNLGYVEFICDNNKNIDIY
FGEWKTSSSKSTIFSGNGRNVVVEPIYNPDTGEDISTSLDFSYEPLYGIDRYINKVLIAPDLYTSLININT
NYYSNEYYPEIIVLNPNTFHKKVNINLDSSSFEYKWSTEGSDFILVRYLEESNKKILQKIRIKGILSNTQS
FNKMSIDFKDIKKLSLGYIMSNFKSFNSENELDRDHLGFKIIDNKTYYYDEDSKLVKGLININNSLFYFDP

```
IEFNLVTGWQTINGKKYYFDINTGAALISYKIINGKHFYFNNDGVMQLGVFKGPDGFEYFAPANTQNN
NIEGQAIVYQSKFLTLNGKKYYFDNDSKAVTGWRIINNEKYYFNPNNAIAAVGLQVIDNNKYYFNPDTA
IISKGWQTVNGSRYYFDTDTAIAFNGYKTIDGKHFYFDSDCVVKIGVFSTSNGFEYFAPANTYNNNIEG
QAIVYQSKFLTLNGKKYYFDNNSKAVTGWQTIDSKKYYFNTNTAEAATGWQTIDGKKYYFNTNTAEA
ATGWQTIDGKKYYFNTNTAIASTGYTIINGKHFYFNTDGIMQIGVFKGPNGFEYFAPANTDANNIEGQA
ILYQNEFLTLNGKKYYFGSDSKAVTGWRIINNKKYYFNPNNAIAAIHLCTINNDKYYFSYDGILQNGYITI
ERNNFYFDANNESKMVTGVFKGPNGFEYFAPANTHNNNIEGQAIVYQNKFLTLNGKKYYFDNDSKAV
TGWQTIDGKKYYFNLNTAEAATGWQTIDGKKYYFNLNTAEAATGWQTIDGKKYYFNTNTFIASTGYTS
INGKHFYFNTDGIMQIGVFKGPNGFEYFAPANTHNNNIEGQAILYQNKFLTLNGKKYYFGSDSKAVTG
LRTIDGKKYYFNTNTAVAVTGWQTINGKKYYFNTNTSIASTGYTIISGKHFYFNTDGIMQIGVFKGPDG
FEYFAPANTDANNIEGQAIRYQNRFLYLHDNIYYFGNNSKAATGWVTIDGNRYYFEPNTAMGANGYK
TIDNKNFYFRNGLPQIGVFKGSNGFEYFAPANTDANNIEGQAIRYQNRFLHLLGKIYYFGNNSKAVTG
WQTINGKVYYFMPDTAMAAAGGLFEIDGVIYFFGVDGVKAPGIYG
Toxin A fragment - TxA4 (Toxinotype 3) (Residues 770-2710)                                SEQ ID 8
IMSDLSSKEYIFFDSIDNKLKAKSKNIPGLASISEDIKTLLLDASVSPDTKFILNNLKLNIESSIGDYIYYEKL
EPVKNIIHNSIDDLIDEFNLLENVSDELYELKKLNNLDEKYLISFEDISKNNSTYSVRFINKSNGESVYVE
TEKEIFSKYSEHITKEISTIKNSIITDVNGNLLDNIQLDHTSQVNTLNAAFFIQSLIDYSSNKDVLNDLSTS
VKVQLYAQLFSTGLNTIYDSIQLVNLISNAVNDTINVLPTITEGIPIVSTILDGINLGAAIKELLDEHDPLLK
KELEAKVGVLAINMSLSIAATVASIVGIGAEVTIFLLPIAGISAGIPSLVNNELILHDKATSVVNYFNHLSES
KEYGPLKTEDDKILVPIDDLVISEIDFNNNSIKLGTCNILAMEGGSGHTVTGNIDHFFSSPYISSHIPSLSV
YSAIGIKTENLDFSKKIMMLPNAPSRVFWWETGAVPGLRSLENNGTKLLDSIRDLYPGKFYWRFYAFF
DYAITTLKPVYEDTNTKIKLDKDTRNFIMPTITTDEIRNKLSYSFDGAGGTYSLLLSSYPISMNINLSKDD
LWIFNIDNEVREISIENGTIKKGNLIEDVLSKIDINKNKLIIGNQTIDFSGDIDNKDRYIFLTCELDDKISLIIEI
NLVAKSYSLLLSGDKNYLISNLSNTIEKINTLGLDSKNIAYNYTDESNNKYFGAISKTSQKSIIHYKKDSK
NILEFYNGSTLEFNSKDFIAEDINVFMKDDINTITGKYYVDNNTDKSIDFSISLVSKNQVKVNGLYLNESV
YSSYLDFVKNSDGHHNTSNFMNLFLNNISFWKLFGFENINFVIDKYFTLVGKTNLGYVEFICDNNKNIDI
YFGEWKTSSSKSTIFSGNGRNVVVEPIYNPDTGEDISTSLDFSYEPLYGIDRYINKVLIAPDLYTSLININ
TNYYSNEYYPEIIVLNPNTFHKKVNINLDSSSFEYKWSTEGSDFILVRYLEESNKKILQKIRIKGILSNTQ
SFNKMSIDFKDIKKLSLGYIMSNFKSFNSENELDRDHLGFKIIDNKTYYYDEDSKLVKGLININNSLFYFD
PIESNLVTGWQTINGKKYYFDINTGAASTSYKIINGKHFYFNNNGVMQLGVFKGPDGFEYFAPANTQN
NNIEGQAIVYQSKFLTLNGKKYYFDNDSKAVTGWRIINNEKYYFNPNNAIAAVGLQVIDNNKYYFNPDT
AIISKGWQTVNGSRYYFDTDTAIAFNGYKTIDGKHFYFDSDCWKIGVFSGSNGFEYFAPANTYNNNIE
GQAIVYQSKFLTLNGKKYYFDNNSKAVTGWQTIDSKKYYFNTNTAEAATGWQTIDGKKYYFNTNTAE
AATGWQTIDGKKYYFNTNTSIASTGYTIINGKYFYFNTDGIMQIGVFKVPNGFEYFAPANTHNNNIEGQ
AILYQNKFLTLNGKKYYFGSDSKAITGWQTIDGKKYYFNPNNAIAATHLCTINNDKYYFSYDGILQNGYI
TIERNNFYFDANNESKMVTGVFKGPNGFEYFAPANTHNNNIEGQAIVYQNKFLTLNGKKYYFDNDSK
AVTGWQTIDSKKYYFNLNTAVAVTGWQTIDGEKYYFNLNTAEAATGWQTIDGKRYYFNTNTYIASTG
YTIINGKHFYFNTDGIMQIGVFKGPDGFEYFAPANTHNNNIEGQAILYQNKFLTLNGKKYYFGSDSKAV
TGLRTIDGKKYYFNTNTAVAVTGWQTINGKKYYFNTNTYIASTGYTIISGKHFYFNTDGIMQIGVFKGP
DGFEYFAPANTDANNIEGQAIRYQNRFLYLHDNIYYFGNDSKAATGWATIDGNRYYFEPNTAMGANG
```

-continued

YKTIDNKNFYFRNGLPQIGVFKGPNGFEYFAPANTDANNIDGQAIRYQNRFLHLLGKIYYFGNNSKAVT
GWQTINSKVYYFMPDTAMAAAGGLFEIDGVIYFFGVDGVKAPGIYG

Toxin B fragment - TxB3(-h) (Toxinotype 0) (Residues 1145-2366)  SEQ ID 9

MPQDDLVISEIDFNNNSIVLGKCEIWRMEGGSGHTVTDDIDHFFSAPSITYREPHLSIYDVLEVQKEEL
DLSKDLMVLPNAPNRVFAWETGWTPGLRSLENDGTKLLDRIRDNYEGEFYWRYFAFIADALITTLKPR
YEDTNIRINLDSNTRSFIVPIITTEYIREKLSYSFYGSGGTYALSLSQYNMGINIELSESDVWIIDVDNVVR
DVTIESDKIKKGDLIEGILSTLSIEENKIILNSHEINFSGEVNGSNGFVSLTFSILEGINAIIEVDLLSKSYKL
LISGELKILMLNSNHIQQKIDYIGFNSELQKNIPYSFVDSEGKENGFINGSTKEGLFVSELPDVVLISKVY
MDDSKPSFGYYSNNLKDVKVITKDNVNILTGYYLKDDIKISLSLTLQDEKTIKLNSVHLDESGVAEILKF
MNRKGNTNTSDSLMSFLESMNIKSIFVNFLQSNIKFILDANFIISGTTSIGQFEFICDENDNIQPYFIKFNT
LETNYTLYVGNRQNMIVEPNYDLDDSGDISSTVINFSQKYLYGIDSCVNKVVISPNIYTDEINITPVYETN
NTYPEVIVLDANYINEKINVNINDLSIRYVWSNDGNDFILMSTSEENKVSQVKIRFVNVFKDKTLANKLS
FNFSDKQDVPVSEIILSFTPSYYEDGLIGYDLGLVSLYNEKFYINNFGMMVSGLIYINDSLYYFKPPVNN
LITGFVTVGDDKYYFNPINGGAASIGETIIDDKNYYFNQSGVLQTGVFSTEDGFKYFAPANTLDENLEG
EAIDFTGKLIIDENIYYFDDNYRGAVEWKELDGEMHYFSPETGKAFKGLNQIGDYKYYFNSDGVMQKG
FVSINDNKHYFDDSGVMKVGYTEIDGKHFYFAENGEMQIGVFNTEDGFKYFAHHNEDLGNEEGEEIS
YSGILNFNNKIYYFDDSFTAVVGWKDLEDGSKYYFDEDTAEAYIGLSLINDGQYYFNDDGIMQVGFVTI
NDKVFYFSDSGIIESGVQNIDDNYFYIDDNGIVQIGVFDTSDGYKYFAPANTVNDNIYGQAVEYSGLVR
VGEDVYYFGETYTIETGWIYDMENESDKYYFNPETKKACKGINLIDDIKYYFDEKGIMRTGLISFENNN
YYFNENGEMQFGYINIEDKMFYFGEDGVMQIGVFNTPDGFKYFAHQNTLDENFEGESINYTGWLDLD
EKRYYFTDEYIAATGSVIIDGEEYYFDPDTAQLVISE

Toxin B fragment - TxB3(-h) (Toxinotype 3) (Residues 1145-2366)  SEQ ID 10

MPQDDLVISEIDFNNNSITLGKCEIWRMEGGSGHTVTDDIDHFFSAPSITYREPHLSIYDVLEVQKEEL
DLSKDLMVLPNAPNRVFAWETGWTPGLRSLENDGTKLLDRIRDNYEGEFYWRYFAFIADALITTLKPR
YEDTNIRINLDSNTRSFIVPVITTEYIREKLSYSFYGSGGTYALSLSQYNMNINIELNENDTVVVIDVDNVV
RDVTIESDKIKKGDLIENILSKLSIEDNKIILDNHEINFSGTLNGGNGFVSLTFSILEGINAVIEVDLLSKSY
KVLISGELKTLMANSNSVQQKIDYIGLNSELQKNIPYSFMDDKGKENGFINCSTKEGLFVSELSDVVLIS
KVYMDNSKPLFGYCSNDLKDVKVITKDDVIILTGYYLKDDIKISLSFTIQDENTIKLNGVYLDENGVAEIL
KFMNKKGSTNTSDSLMSFLESMNIKSIFINSLQSNTKLILDTNFIISGTTSIGQFEFICDKDNNIQPYFIKF
NTLETKYTLYVGNRQNMIVEPNYDLDDSGDISSTVINFSQKYLYGIDSCVNKVIISPNIYTDEINITPIYEA
NNTYPEVIVLDTNYISEKININDLSIRYVWSNDGSDFILMSTDEENKVSQVKIRFTNVFKGNTISDKISF
NFSDKQDVSINKVISTFTPSYYVEGLLNYDLGLISLYNEKFYINNFGMMVSGLVYINDSLYYFKPPIKNLI
TGFTTIGDDKYYFNPDNGGAASVGETIIDGKNYYFSQNGVLQTGVFSTEDGFKYFAPADTLDENLEGE
AIDFTGKLTIDENVYYFGDNYRAAIEWQTLDDEVYYFSTDTGRAFKGLNQIGDDKFYFNSDGIMQKGF
VNINDKTFYFDDSGVMKSGYTEIDGKYFYFAENGEMQIGVFNTADGFKYFAHHDEDLGNEEGEALSY
SGILNFNNKIYYFDDSFTAVVGWKDLEDGSKYYFDEDTAEAYIGISIINDGKYYFNDSGIMQIGFVTINN
EVFYFSDSGIVESGMQNIDDNYFYIDENGLVQIGVFDTSDGYKYFAPANTVNDNIYGQAVEYSGLVRV
GEDVYYFGETYTIETGWIYDMENESDKYYFDPETKKAYKGINVIDDIKYYFDENGIMRTGLITFEDNHY
YFNEDGIMQYGYLNIEDKTFYFSEDGIMQIGVFNTPDGFKYFAHQNTLDENFEGESINYTGWLDLDEK
RYYFTDEYIAATGSVIIDGEEYYFDPDTAQLVISE

Toxin B fragment - TxB3 (Toxinotype 0) (Residues 957-2366)

SEQ ID 11

NTLNAAFFIQSLIEYNSSKESLSNLSVAMKVQVYAQLFSTGLNTITDAAKVVELVSTALDETIDLLPTLSE
GLPIIATIIDGVSLGAAIKELSETSDPLLRQEIEAKIGIMAVNLTTATTAIITSSLGIASGFSILLVPLAGISAGI
PSLVNNELVLRDKATKVVDYFKHVSLVETEGVFTLLDDKIMMPQDDLVISEIDFNNNSIVLGKCEIWRM
EGGSGHTVTDDIDHFFSAPSITYREPHLSIYDVLEVQKEELDLSKDLMVLPNAPNRVFAWETGWTPGL
RSLENDGTKLLDRIRDNYEGEFYWRYFAFIADALITTLKPRYEDTNIRINLDSNTRSFIVPIITTEYIREKL
SYSFYGSGGTYALSLSQYNMGINIELSESDVWIIDVDNVVRDVTIESDKIKKGDLIEGILSTLSIEENKIIL
NSHEINFSGEVNGSNGFVSLTFSILEGINAIIEVDLLSKSYKLLISGELKILMLNSNHIQQKIDYIGFNSEL
QKNIPYSFVDSEGKENGFINGSTKEGLFVSELPDVVLISKVYMDDSKPSFGYYSNNLKDVKVITKDNV
NILTGYYLKDDIKISLSLTLQDEKTIKLNSVHLDESGVAEILKFMNRKGNTNTSDSLMSFLESMNIKSIFV
NFLQSNIKFILDANFIISGTTSIGQFEFICDENDNIQPYFIKFNTLETNYTLYVGNRQNMIVEPNYDLDDS
GDISSTVINFSQKYLYGIDSCVNKVVISPNIYTDEINITPVYETNNTYPEVIVLDANYINEKINVNINDLSIR
YVWSNDGNDFILMSTSEENKVSQVKIRFVNVFKDKTLANKLSFNFSDKQDVPVSEIILSFTPSYYEDGL
IGYDLGLVSLYNEKFYINNFGMMVSGLIYINDSLYYFKPPVNNLITGFVTVGDDKYYFNPINGGAASIGE
TIIDDKNYYFNQSGVLQTGVFSTEDGFKYFAPANTLDENLEGEAIDFTGKLIIDENIYYFDDNYRGAVE
WKELDGEMHYFSPETGKAFKGLNQIGDYKYYFNSDGVMQKGFVSINDNKHYFDDSGVMKVGYTEID
GKHFYFAENGEMQIGVFNTEDGFKYFAHHNEDLGNEEGEEISYSGILNFNNKIYYFDDSFTAVVGWK
DLEDGSKYYFDEDTAEAYIGLSLINDGQYYFNDDGIMQVGFVTINDKVFYFSDSGIIESGVQNIDDNYF
YIDDNGIVQIGVFDTSDGYKYFAPANTVNDNIYGQAVEYSGLRVGEDVYYFGETYTIETGWIYDMEN
ESDKYYFNPETKKACKGINLIDDIKYYFDEKGIMRTGLISFENNNYYFNENGEMQFGYINIEDKMFYFG
EDGVMQIGVFNTPDGFKYFAHQNTLDENFEGESINYTGWLDLDEKRYYFTDEYIAATGSVIIDGEEYY
FDPDTAQLVISE

Toxin B fragment - TxB3 (Toxinotype 3) (Residues 957-2366)

SEQ ID 12

NTLNAAFFIQSLIEYNSSKESLSNLSVAMKVQVYAQLFSTGLNTITDAAKVVELVSTALDETIDLLPTLSE
GLPVIATIIDGVSLGAAIKELSETSDPLLRQEIEAKIGIMAVNLTAATTAIITSSLGIASGFSILLVPLAGISA
GIPSLVNNELILRDKATKVVDYFSHISLAESEGAFTSLDDKIMMPQDDLVISEIDFNNNSITLGKCEIWR
MEGGSGHTVTDDIDHFFSAPSITYREPHLSIYDVLEVQKEELDLSKDLMVLPNAPNRVFAWETGWTP
GLRSLENDGTKLLDRIRDNYEGEFYWRYFAFIADALITTLKPRYEDTNIRINLDSNTRSFIVPVITTEYIR
EKLSYSFYGSGGTYALSLSQYNMNINIELNENDTVVVIDVDNVVRDVTIESDKIKKGDLIENILSKLSIEDN
KIILDNHEINFSGTLNGGNGFVSLTFSILEGINAVIEVDLLSKSYKVLISGELKTLMANSNSVQQKIDYIGL
NSELQKNIPYSFMDDKGKENGFINCSTKEGLFVSELSDVVLISKVYMDNSKPLFGYCSNDLKDVKVITK
DDVIILTGYYLKDDIKISLSFTIQDENTIKLNGVYLDENGVAEILKFMNKKGSTNTSDSLMSFLESMNIKSI
FINSLQSNTKLILDTNFIISGTTSIGQFEFICDKDNNIQPYFIKFNTLETKYTLYVGNRQNMIVEPNYDLDD
SGDISSTVINFSQKYLYGIDSCVNKVIISPNIYTDEINITPIYEANNTYPEVIVLDTNYISEKINININDLSIRY
VWSNDGSDFILMSTDEENKVSQVKIRFTNVFKGNTISDKISFNFSDKQDVSINKVISTFTPSYYVEGLL
NYDLGLISLYNEKFYINNFGMMVSGLVYINDSLYYFKPPIKNLITGFTTIGDDKYYFNPDNGGAASVGET
IIDGKNYYFSQNGVLQTGVFSTEDGFKYFAPADTLDENLEGEAIDFTGKLTIDENVYYFGDNYRAAIEW
QTLDDEVYYFSTDTGRAFKGLNQIGDDKFYFNSDGIMQKGFVNINDKTFYFDDSGVMKSGYTEIDGK
YFYFAENGEMQIGVFNTADGFKYFAHHDEDLGNEEGEALSYSGILNFNNKIYYFDDSFTAVVGWKDL
EDGSKYYFDEDTAEAYIGISIINDGKYYFNDSGIMQIGFVTINNEVFYFSDSGIVESGMQNIDDNYFYID
ENGLVQIGVFDTSDGYKYFAPANTVNDNIYGQAVEYSGLRVGEDVYYFGETYTIETGWIYDMENES

-continued

```
DKYYFDPETKKAYKGINVIDDIKYYFDENGIMRTGLITFEDNHYYFNEDGIMQYGYLNIEDKTFYFSED

GIMQIGVFNTPDGFKYFAHQNTLDENFEGESINYTGWLDLDEKRYYFTDEYIAATGSVIIDGEEYYFDP

DTAQLVISE
```

Toxin B fragment - TxB 4 (Toxinotype 0) (Residues 767-2366)          SEQ ID 13

```
SIIKDISSKEYISFNPKENKITVKSKNLPELSTLLQEIRNNSNSSDIELEEKVMLTECEINVISNIDTQIVEE

RIEEAKNLTSDSINYIKDEFKLIESISDALCDLKQQNELEDSHFISFEDISETDEGFSIRFINKETGESIFVE

TEKTIFSEYANHITEEISKIKGTIFDTVNGKLVKKVNLDTTHEVNTLNAAFFIQSLIEYNSSKESLSNLSVA

MKVQVYAQLFSTGLNTITDAAKVVELVSTALDETIDLLPTLSEGLPIIATIIDGVSLGAAIKELSETSDPLL

RQEIEAKIGIMAVNLTTATTAIITSSLGIASGFSILLVPLAGISAGIPSLVNNELVLRDKATKVVDYFKHVSL

VETEGVFTLLDDKIMMPQDDLVISEIDFNNNSIVLGKCEIWRMEGGSGHTVTDDIDHFFSAPSITYREP

HLSIYDVLEVQKEELDLSKDLMVLPNAPNRVFAWETGWTPGLRSLENDGTKLLDRIRDNYEGEFYWR

YFAFIADALITTLKPRYEDTNIRINLDSNTRSFIVPIITTEYIREKLSYSFYGSGGTYALSLSQYNMGINIEL

SESDVWIIDVDNVVRDVTIESDKIKKGDLIEGILSTLSIEENKIILNSHEINFSGEVNGSNGFVSLTFSILEG

INAIIEVDLLSKSYKLLISGELKILMLNSNHIQQKIDYIGFNSELQKNIPYSFVDSEGKENGFINGSTKEGL

FVSELPDVVLISKVYMDDSKPSFGYYSNNLKDVKVITKDNVNILTGYYLKDDIKISLSLTLQDEKTIKLNS

VHLDESGVAEILKFMNRKGNTNTSDSLMSFLESMNIKSIFVNFLQSNIKFILDANFIISGTTSIGQFEFICD

ENDNIQPYFIKFNTLETNYTLYVGNRQNMIVEPNYDLDDSGDISSTVINFSQKYLYGIDSCVNKVVISPN

IYTDEINITPVYETNNTYPEVIVLDANYINEKINVNINDLSIRYVWSNDGNDFILMSTSEENKVSQVKIRFV

NVFKDKTLANKLSFNFSDKQDVPVSEIILSFTPSYYEDGLIGYDLGLVSLYNEKFYINNFGMMVSGLIYI

NDSLYYFKPPVNNLITGFVTVGDDKYYFNPINGGAASIGETIIDDKNYYFNQSGVLQTGVFSTEDGFKY

FAPANTLDENLEGEAIDFTGKLIIDENIYYFDDNYRGAVEWKELDGEMHYFSPETGKAFKGLNQIGDY

KYYFNSDGVMQKGFVSINDNKHYFDDSGVMKVGYTEIDGKHFYFAENGEMQIGVFNTEDGFKYFAH

HNEDLGNEEGEEISYSGILNFNNKIYYFDDSFTAVVGWKDLEDGSKYYFDEDTAEAYIGLSLINDGQY

YFNDDGIMQVGFVTINDKVFYFSDSGIIESGVQNIDDNYFYIDDNGIVQIGVFDTSDGYKYFAPANTVN

DNIYGQAVEYSGLVRVGEDVYYFGETYTIETGWIYDMENESDKYYFNPETKKACKGINLIDDIKYYFDE

KGIMRTGLISFENNNYYFNENGEMQFGYINIEDKMFYFGEDGVMQIGVFNTPDGFKYFAHQNTLDEN

FEGESINYTGWLDLDEKRYYFTDEYIAATGSVIIDGEEYYFDPDTAQLVISE
```

Toxin B fragment - TxB 4 (Toxinotype 3) (Residues 767-2366)          SEQ ID 14

```
SIIKDISSKEYISFNPKENKIIVKSKNLPELSTLLQEIRNNSNSSDIELEEKVMLAECEINVISNIDTQVVEG

RIEEAKSLTSDSINYIKNEFKLIESISDALYDLKQQNELEESHFISFEDILETDEGFSIRFIDKETGESIFVE

TEKAIFSEYANHITEEISKIKGTIFDTVNGKLVKKVNLDATHEVNTLNAAFFIQSLIEYNSSKESLSNLSVA

MKVQVYAQLFSTGLNTITDAAKVVELVSTALDETIDLLPTLSEGLPVIATIIDGVSLGAAIKELSETSDPLL

RQEIEAKIGIMAVNLTAATTAIITSSLGIASGFSILLVPLAGISAGIPSLVNNELIRDKATKVVDYFSHISLA

ESEGAFTSLDDKIMMPQDDLVISEIDFNNNSITLGKCEIWRMEGGSGHTVTDDIDHFFSAPSITYREPH

LSIYDVLEVQKEELDLSKDLMVLPNAPNRVFAWETGWTPGLRSLENDGTKLLDRIRDNYEGEFYWRY

FAFIADALITTLKPRYEDTNIRINLDSNTRSFIVPVITTEYIREKLSYSFYGSGGTYALSLSQYNMNINIEL

NENDTWVIDVDNVVRDVTIESDKIKKGDLIENILSKLSIEDNKIILDNHEINFSGTLNGGNGFVSLTFSILE

GINAVIEVDLLSKSYKVLISGELKTLMANSNSVQQKIDYIGLNSELQKNIPYSFMDDKGKENGFINCSTK

EGLFVSELSDVVLISKVYMDNSKPLFGYCSNDLKDVKVITKDDVIILTGYYLKDDIKISLSFTIQDENTIKL

NGVYLDENGVAEILKFMNKKGSTNTSDSLMSFLESMNIKSIFINSLQSNTKLILDTNFIISGTTSIGQFEFI
```

-continued

```
CDKDNNIQPYFIKFNTLETKYTLYVGNRQNMIVEPNYDLDDSGDISSTVINFSQKYLYGIDSCVNKVIIS

PNIYTDEINITPIYEANNTYPEVIVLDTNYISEKININIINDLSIRYVWSNDGSDFILMSTDEENKVSQVKIRF

TNVFKGNTISDKISFNFSDKQDVSINKVISTFTPSYYVEGLLNYDLGLISLYNEKFYINNFGMMVSGLVYI

NDSLYYFKPPIKNLITGFTTIGDDKYYFNPDNGGAASVGETIIDGKNYYFSQNGVLQTGVFSTEDGFKY

FAPADTLDENLEGEAIDFTGKLTIDENVYYFGDNYRAAIEWQTLDDEVYYFSTDTGRAFKGLNQIGDD

KFYFNSDGIMQKGFVNINDKTFYFDDSGVMKSGYTEIDGKYFYFAENGEMQIGVFNTADGFKYFAHH

DEDLGNEEGEALSYSGILNFNNKIYYFDDSFTAVVGWKDLEDGSKYYFDEDTAEAYIGISIINDGKYYF

NDSGIMQIGFVTINNEVFYFSDSGIVESGMQNIDDNYFYIDENGLVQIGVFDTSDGYKYFAPANTVNDN

IYGQAVEYSGLVRVGEDVYYFGETYTIETGWIYDMENESDKYYFDPETKKAYKGINVIDDIKYYFDENG

IMRTGLITFEDNHYYFNEDGIMQYGYLNIEDKTFYFSEDGIMQIGVFNTPDGFKYFAHQNTLDENFEGE

SINYTGWLDLDEKRYYFTDEYIAATGSVIIDGEEYYFDPDTAQLVISE
```

Toxin B fragment - Toxin B-A hybrid (toxinotype 0)                                   SEQ ID 15

```
NTLNAAFFIQSLIEYNSSKESLSNLSVAMKVQVYAQLFSTGLNTITDAAKVVELVSTALDETIDLLPTLSE

GLPIIATIIDGVSLGAAIKELSETSDPLLRQEIEAKIGIMAVNLTTATTAIITSSLGIASGFSILLVPLAGISAGI

PSLVNNELVLRDKATKVVDYFKHVSLVETEGVFTLLDDKIMMPQDDLVISEIDFNNNSIVLGKCEIWRM

EGGSGHTVTDDIDHFFSAPSITYREPHLSIYDVLEVQKEELDLSKDLMVLPNAPNRVFAWETGWTPGL

RSLENDGTKLLDRIRDNYEGEFYWRYFAFIADALITTLKPRYEDTNIRINLDSNTRSFIVPIITTEYIREKL

SYSFYGSGGTYALSLSQYNMGINIELSESDVWIIDVDNVVRDVTIESDKIKKGDLIEGILSTLSIEENKIIL

NSHEINFSGEVNGSNGFVSLTFSILEGINAIIEVDLLSKSYKLLISGELKILMLNSNHIQQKIDYIGFNSEL

QKNIPYSFVDSEGKENGFINGSTKEGLFVSELPDVVLISKVYMDDSKPSFGYYSNNLKDVKVITKDNV

NILTGYYLKDDIKISLSLTLQDEKTIKLNSVHLDESGVAEILKFMNRKGNTNTSDSLMSFLESMNIKSIFV

NFLQSNIKFILDANFIISGTTSIGQFEFICDENDNIQPYFIKFNTLETNYTLYVGNRQNMIVEPNYDLDDS

GDISSTVINFSQKYLYGIDSCVNKVVISPNIYTDEINITPVYETNNTYPEVIVLDANYINEKINVNINDLSIR

YVWSNDGNDFILMSTSEENKVSQVKIRFVNVFKDKTLANKLSFNFSDKQDVPVSEIILSFTPSYYEDGL

IGYDLGLVSLYNEKFYINNFGMMVSGLIYINDSLYYFKPPVNNLVTGWQTINGKKYYFDINTGAALISYK

IINGKHFYFNNDGVMQLGVFKGPDGFEYFAPANTQNNNIEGQAIVYQSKFLTLNGKKYYFDNDSKAVT

GWRIINNEKYYFNPNNAIAAVGLQVIDNNKYYFNPDTAIISKGWQTVNGSRYYFDTDTAIAFNGYKTID

GKHFYFDSDCVVKIGVFSTSNGFEYFAPANTYNNNIEGQAIVYQSKFLTLNGKKYYFDNNSKAVTGW

QTIDSKKYYFNTNTAEAATGWQTIDGKKYYFNTNTAEAATGWQTIDGKKYYFNTNTAIASTGYTIINGK

HFYFNTDGIMQIGVFKGPNGFEYFAPANTDANNIEGQAILYQNEFLTLNGKKYYFGSDSKAVTGWRIIN

NKKYYFNPNNAIAAIHLCTINNDKYYFSYDGILQNGYITIERNNFYFDANNESKMVTGVFKGPNGFEYF

APANTHNNNIEGQAIVYQNKFLTLNGKKYYFDNDSKAVTGWQTIDGKKYYFNLNTAEAATGWQTIDG

KKYYFNLNTAEAATGWQTIDGKKYYFNTNTFIASTGYTSINGKHFYFNTDGIMQIGVFKGPNGFEYFA

PANTHNNNIEGQAILYQNKFLTLNGKKYYFGSDSKAVTGLRTIDGKKYYFNTNTAVAVTGWQTINGKK

YYFNTNTSIASTGYTIISGKHFYFNTDGIMQIGVFKGPDGFEYFAPANTDANNIEGQAIRYQNRFLYLHD

NIYYFGNNSKAATGWVTIDGNRYYFEPNTAMGANGYKTIDNKNFYFRNGLPQIGVFKGSNGFEYFAP

ANTDANNIEGQAIRYQNRFLHLLGKIYYFGNNSKAVTGWQTINGKVYYFMPDTAMAAAGGLFEIDGVI

YFFGVDGVKAPGIYG
```

Toxin B fragment - Toxin A-B hybrid (toxinotype 0)                                   SEQ ID 16

```
IMSDLSSKEYIFFDSIDNKLKAKSKNIPGLASISEDIKTLLLDASVSPDTKFILNNLKLNIESSIGDYIYYEKL

EPVKNIIHNSIDDLIDEFNLLENVSDELYELKKLNNLDEKYLISFEDISKNNSTYSVRFINKSNGESVYVE
```

```
TEKEIFSKYSEHITKEISTIKNSIITDVNGNLLDNIQLDHTSQVNTLNAAFFIQSLIDYSSNKDVLNDLSTS

VKVQLYAQLFSTGLNTIYDSIQLVNLISNAVNDTINVLPTITEGIPIVSTILDGINLGAAIKELLDEHDPLLK

KELEAKVGVLAINMSLSIAATVASIVGIGAEVTIFLLPIAGISAGIPSLVNNELILHDKATSVVNYFNHLSES

KKYGPLKTEDDKILVPIDDLVISEIDFNNNSIKLGTCNILAMEGGSGHTVTGNIDHFFSSPSISSHIPSLSI

YSAIGIETENLDFSKKIMMLPNAPSRVFWWETGAVPGLRSLENDGTRLLDSIRDLYPGKFYWRFYAFF

DYAITTLKPVYEDTNIKIKLDKDTRNFIMPTITTNEIRNKLSYSFDGAGGTYSLLLSSYPISTNINLSKDDL

WIFNIDNEVREISIENGTIKKGKLIKDVLSKIDINKNKLIIGNQTIDFSGDIDNKDRYIFLTCELDDKISLIIEIN

LVAKSYSLLLSGDKNYLISNLSNIIEKINTLGLDSKNIAYNYTDESNNKYFGAISKTSQKSIIHYKKDSKNI

LEFYNDSTLEFNSKDFIAEDINVFMKDDINTITGKYYVDNNTDKSIDFSISLVSKNQVKVNGLYLNESVY

SSYLDFVKNSDGHHNTSNFMNLFLDNISFWKLFGFENINFVIDKYFTLVGKTNLGYVEFICDNNKNIDIY

FGEWKTSSSKSTIFSGNGRNVVVEPIYNPDTGEDISTSLDFSYEPLYGIDRYINKVLIAPDLYTSLININT

NYYSNEYYPEIIVLNPNTFHKKVNINLDSSSFEYKWSTEGSDFILVRYLEESNKKILQKIRIKGILSNTQS

FNKMSIDFKDIKKLSLGYIMSNFKSFNSENELDRDHLGFKIIDNKTYYYDEDSKLVKGLININNSLFYFDP

IEFNLITGFVTVGDDKYYFNPINGGAASIGETIIDDKNYYFNQSGVLQTGVFSTEDGFKYFAPANTLDEN

LEGEAIDFTGKLIIDENIYYFDDNYRGAVEWKELDGEMHYFSPETGKAFKGLNQIGDYKYYFNSDGVM

QKGFVSINDNKHYFDDSGVMKVGYTEIDGKHFYFAENGEMQIGVFNTEDGFKYFAHHNEDLGNEEG

EEISYSGILNFNNKIYYFDDSFTAVVGWKDLEDGSKYYFDEDTAEAYIGLSLINDGQYYFNDDGIMQVG

FVTINDKVFYFSDSGIIESGVQNIDDNYFYIDDNGIVQIGVFDTSDGYKYFAPANTVNDNIYGQAVEYSG

LVRVGEDVYYFGETYTIETGWIYDMENESDKYYFNPETKKACKGINLIDDIKYYFDEKGIMRTGLISFEN

NNYYFNENGEMQFGYINIEDKMFYFGEDGVMQIGVFNTPDGFKYFAHQNTLDENFEGESINYTGWLD

LDEKRYYFTDEYIAATGSVIIDGEEYYFDPDTAQLVISE

Toxin B fragment - Toxin A-B hybrid (toxinotype 0 and 3)
                                                                                    SEQ ID 17
IMSDLSSKEYIFFDSIDNKLKAKSKNIPGLASISEDIKTLLLDASVSPDTKFILNNLKLNIESSIGDYIYYEKL

EPVKNIIHNSIDDLIDEFNLLENVSDELYELKKLNNLDEKYLISFEDISKNNSTYSVRFINKSNGESVYVE

TEKEIFSKYSEHITKEISTIKNSIITDVNGNLLDNIQLDHTSQVNTLNAAFFIQSLIDYSSNKDVLNDLSTS

VKVQLYAQLFSTGLNTIYDSIQLVNLISNAVNDTINVLPTITEGIPIVSTILDGINLGAAIKELLDEHDPLLK

KELEAKVGVLAINMSLSIAATVASIVGIGAEVTIFLLPIAGISAGIPSLVNNELILHDKATSVVNYFNHLSES

KKYGPLKTEDDKILVPIDDLVISEIDFNNNSIKLGTCNILAMEGGSGHTVTGNIDHFFSSPSISSHIPSLSI

YSAIGIETENLDFSKKIMMLPNAPSRVFWWETGAVPGLRSLENDGTRLLDSIRDLYPGKFYWRFYAFF

DYAITTLKPVYEDTNIKIKLDKDTRNFIMPTITTNEIRNKLSYSFDGAGGTYSLLLSSYPISTNINLSKDDL

WIFNIDNEVREISIENGTIKKGKLIKDVLSKIDINKNKLIIGNQTIDFSGDIDNKDRYIFLTCELDDKISLIIEIN

LVAKSYSLLLSGDKNYLISNLSNIIEKINTLGLDSKNIAYNYTDESNNKYFGAISKTSQKSIIHYKKDSKNI

LEFYNDSTLEFNSKDFIAEDINVFMKDDINTITGKYYVDNNTDKSIDFSISLVSKNQVKVNGLYLNESVY

SSYLDFVKNSDGHHNTSNFMNLFLDNISFWKLFGFENINFVIDKYFTLVGKTNLGYVEFICDNNKNIDIY

FGEWKTSSSKSTIFSGNGRNVVVEPIYNPDTGEDISTSLDFSYEPLYGIDRYINKVLIAPDLYTSLININT

NYYSNEYYPEIIVLNPNTFHKKVNINLDSSSFEYKWSTEGSDFILVRYLEESNKKILQKIRIKGILSNTQS

FNKMSIDFKDIKKLSLGYIMSNFKSFNSENELDRDHLGFKIIDNKTYYYDEDSKLVKGLININNSLFYFDP

IEFNLITGFTTIGDDKYYFNPDNGGAASVGETIIDGKNYYFSQNGVLQTGVFSTEDGFKYFAPADTLDE

NLEGEAIDFTGKLTIDENVYYFGDNYRAAIEWQTLDDEVYYFSTDTGRAFKGLNQIGDDKFYFNSDGI

MQKGFVNINDKTFYFDDSGVMKSGYTEIDGKYFYFAENGEMQIGVFNTADGFKYFAHHDEDLGNEE
```

-continued

GEALSYSGILNFNNKIYYFDDSFTAVVGWKDLEDGSKYYFDEDTAEAYIGISIINDGKYYFNDSGIMQIG

FVTINNEVFYFSDSGIVESGMQNIDDNYFYIDENGLVQIGVFDTSDGYKYFAPANTVNDNIYGQAVEYS

GLVRVGEDVYYFGETYTIETGWIYDMENESDKYYFDPETKKAYKGINVIDDIKYYFDENGIMRTGLITF

EDNHYYFNEDGIMQYGYLNIEDKTFYFSEDGIMQIGVFNTPDGFKYFAHQNTLDENFEGESINYTGWL

DLDEKRYYFTDEYIAATGSVIIDGEEYYFDPDTAQLVISE

Toxin A-derived recombinant antigen His-NusA-[thrombin site]-TxA4-His
SEQ ID 18

HHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAERAMVV

DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALVPRGSVTSLYKKAGSAAAPFTMIMSDLSSKEYIFFDSIDN

KLKAKSKNIPGLASISEDIKTLLLDASVSPDTKFILNNLKLNIESSIGDYIYYEKLEPVKNIIHNSIDDLIDEF

NLLENVSDELYELKKLNNLDEKYLISFEDISKNNSTYSVRFINKSNGESVYVETEKEIFSKYSEHITKEIS

TIKNSIITDVNGNLLDNIQLDHTSQVNTLNAAFFIQSLIDYSSNKDVLNDLSTSVKVQLYAQLFSTGLNTI

YDSIQLVNLISNAVNDTINVLPTITEGIPIVSTILDGINLGAAIKELLDEHDPLLKKELEAKVGVLAINMSLSI

AATVASIVGIGAEVTIFLLPIAGISAGIPSLVNNELILHDKATSVVNYFNHLSESKKYGPLKTEDDKILVPID

DLVISEIDFNNNSIKLGTCNILAMEGGSGHTVTGNIDHFFSSPSISSHIPSLSIYSAIGIETENLDFSKKIM

MLPNAPSRVFWWETGAVPGLRSLENDGTRLLDSIRDLYPGKFYWRFYAFFDYAITTLKPVYEDTNIKI

KLDKDTRNFIMPTITTNEIRNKLSYSFDGAGGTYSLLLSSYPISTNINLSKDDLWIFNIDNEVREISIENGT

IKKGKLIKDVLSKIDINKNKLIIGNQTIDFSGDIDNKDRYIFLTCELDDKISLIIEINLVAKSYSLLLSGDKNYL

ISNLSNIIEKINTLGLDSKNIAYNYTDESNNKYFGAISKTSQKSIIHYKKDSKNILEFYNDSTLEFNSKDFIA

EDINVFMKDDINTITGKYYVDNNTDKSIDFSISLVSKNQVKVNGLYLNESVYSSYLDFVKNSDGHHNTS

NFMNLFLDNISFWKLFGFENINFVIDKYFTLVGKTNLGYVEFICDNNKNIDIYFGEWKTSSSKSTIFSGN

GRNVVVEPIYNPDTGEDISTSLDFSYEPLYGIDRYINKVLIAPDLYTSLININTNYYSNEYYPEIIVLNPNT

FHKKVNINLDSSSFEYKWSTEGSDFILVRYLEESNKKILQKIRIKGILSNTQSFNKMSIDFKDIKKLSLGYI

MSNFKSFNSENELDRDHLGFKIIDNKTYYYDEDSKLVKGLININNSLFYFDPIEFNLVTGWQTINGKKYY

FDINTGAALISYKIINGKHFYFNNDGVMQLGVFKGPDGFEYFAPANTQNNNIEGQAIVYQSKFLTLNGK

KYYFDNDSKAVTGWRIINNEKYYFNPNNAIAAVGLQVIDNNKYYFNPDTAIISKGWQTVNGSRYYFDT

DTAIAFNGYKTIDGKHFYFDSDCVVKIGVFSTSNGFEYFAPANTYNNNIEGQAIVYQSKFLTLNGKKYY

FDNNSKAVTGWQTIDSKKYYFNTNTAEAATGWQTIDGKKYYFNTNTAEAATGWQTIDGKKYYFNTNT

AIASTGYTIINGKHFYFNTDGIMQIGVFKGPNGFEYFAPANTDANNIEGQAILYQNEFLTLNGKKYYFGS

DSKAVTGWRIINNKKYYFNPNNAIAAIHLCTINNDKYYFSYDGILQNGYITIERNNFYFDANNESKMVTG

VFKGPNGFEYFAPANTHNNNIEGQAIVYQNKFLTLNGKKYYFDNDSKAVTGWQTIDGKKYYFNLNTA

EAATGWQTIDGKKYYFNLNTAEAATGWQTIDGKKYYFNTNTFIASTGYTSINGKHFYFNTDGIMQIGV

FKGPNGFEYFAPANTHNNNIEGQAILYQNKFLTLNGKKYYFGSDSKAVTGLRTIDGKKYYFNTNTAVA

VTGWQTINGKKYYFNTNTSIASTGYTIISGKHFYFNTDGIMQIGVFKGPDGFEYFAPANTDANNIEGQA

-continued

```
IRYQNRFLYLHDNIYYFGNNSKAATGWVTIDGNRYYFEPNTAMGANGYKTIDNKNFYFRNGLPQIGVF

KGSNGFEYFAPANTDANNIEGQAIRYQNRFLHLLGKIYYFGNNSKAVTGWQTINGKVYYFMPDTAMA

AAGGLFEIDGVIYFFGVDGVKAPGIYGGGSGGSLVPRGSGGSHHHHHH
```

Toxin A-derived recombinant antigen His-NusA-[thrombin site]-TxA4 SEQ ID 19

HHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAERAMVV

DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALVPRGSVTSLYKKAGSAAAPFTMIMSDLSSKEYIFFDSIDN

KLKAKSKNIPGLASISEDIKTLLLDASVSPDTKFILNNLKLNIESSIGDYIYYEKLEPVKNIIHNSIDDLIDEF

NLLENVSDELYELKKLNNLDEKYLISFEDISKNNSTYSVRFINKSNGESVYVETEKEIFSKYSEHITKEIS

TIKNSIITDVNGNLLDNIQLDHTSQVNTLNAAFFIQSLIDYSSNKDVLNDLSTSVKVQLYAQLFSTGLNTI

YDSIQLVNLISNAVNDTINVLPTITEGIPIVSTILDGINLGAAIKELLDEHDPLLKKELEAKVGVLAINMSLSI

AATVASIVGIGAEVTIFLLPIAGISAGIPSLVNNELILHDKATSVVNYFNHLSESKKYGPLKTEDDKILVPID

DLVISEIDFNNNSIKLGTCNILAMEGGSGHTVTGNIDHFFSSPSISSHIPSLSIYSAIGIETENLDFSKKIM

MLPNAPSRVFWWETGAVPGLRSLENDGTRLLDSIRDLYPGKFYWRFYAFFDYAITTLKPVYEDTNIKI

KLDKDTRNFIMPTITTNEIRNKLSYSFDGAGGTYSLLLSSYPISTNINLSKDDLWIFNIDNEVREISIENGT

IKKGKLIKDVLSKIDINKNKLIIGNQTIDFSGDIDNKDRYIFLTCELDDKISLIIEINLVAKSYSLLLSGDKNYL

ISNLSNIIEKINTLGLDSKNIAYNYTDESNNKYFGAISKTSQKSIIHYKKDSKNILEFYNDSTLEFNSKDFIA

EDINVFMKDDINTITGKYYVDNNTDKSIDFSISLVSKNQVKVNGLYLNESVYSSYLDFVKNSDGHHNTS

NFMNLFLDNISFWKLFGFENINFVIDKYFTLVGKTNLGYVEFICDNNKNIDIYFGEWKTSSSKSTIFSGN

GRNVVVEPIYNPDTGEDISTSLDFSYEPLYGIDRYINKVLIAPDLYTSLININTNYYSNEYYPEIIVLNPNT

FHKKVNINLDSSSFEYKWSTEGSDFILVRYLEESNKKILQKIRIKGILSNTQSFNKMSIDFKDIKKLSLGYI

MSNFKSFNSENELDRDHLGFKIIDNKTYYYDEDSKLVKGLININNSLFYFDPIEFNLVTGWQTINGKKYY

FDINTGAALISYKIINGKHFYFNNDGVMQLGVFKGPDGFEYFAPANTQNNNIEGQAIVYQSKFLTLNGK

KYYFDNDSKAVTGWRIINNEKYYFNPNNAIAAVGLQVIDNNKYYFNPDTAIISKGWQTVNGSRYYFDT

DTAIAFNGYKTIDGKHFYFDSDCVVKIGVFSTSNGFEYFAPANTYNNNIEGQAIVYQSKFLTLNGKKYY

FDNNSKAVTGWQTIDSKKYYFNTNTAEAATGWQTIDGKKYYFNTNTAEAATGWQTIDGKKYYFNTNT

AIASTGYTIINGKHFYFNTDGIMQIGVFKGPNGFEYFAPANTDANNIEGQAILYQNEFLTLNGKKYYFGS

DSKAVTGWRIINNKKYYFNPNNAIAAIHLCTINNDKYYFSYDGILQNGYITIERNNFYFDANNESKMVTG

VFKGPNGFEYFAPANTHNNNIEGQAIVYQNKFLTLNGKKYYFDNDSKAVTGWQTIDGKKYYFNLNTA

EAATGWQTIDGKKYYFNLNTAEAATGWQTIDGKKYYFNTNTFIASTGYTSINGKHFYFNTDGIMQIGV

FKGPNGFEYFAPANTHNNNIEGQAILYQNKFLTLNGKKYYFGSDSKAVTGLRTIDGKKYYFNTNTAVA

VTGWQTINGKKYYFNTNTSIASTGYTIISGKHFYFNTDGIMQIGVFKGPDGFEYFAPANTDANNIEGQA

IRYQNRFLYLHDNIYYFGNNSKAATGWVTIDGNRYYFEPNTAMGANGYKTIDNKNFYFRNGLPQIGVF

KGSNGFEYFAPANTDANNIEGQAIRYQNRFLHLLGKIYYFGNNSKAVTGWQTINGKVYYFMPDTAMA

AAGGLFEIDGVIYFFGVDGVKAPGIYG

-continued

Toxin A-derived recombinant antigen - His-Thioredoxin-[thrombin site]-TxA4 SEQ ID 20

HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALVPRGSVTSLYKKAGSA

AAPFTMIMSDLSSKEYIFFDSIDNKLKAKSKNIPGLASISEDIKTLLLDASVSPDTKFILNNLKLNIESSIGD

YIYYEKLEPVKNIIHNSIDDLIDEFNLLENVSDELYELKKLNNLDEKYLISFEDISKNNSTYSVRFINKSNG

ESVYVETEKEIFSKYSEHITKEISTIKNSIITDVNGNLLDNIQLDHTSQVNTLNAAFFIQSLIDYSSNKDVL

NDLSTSVKVQLYAQLFSTGLNTIYDSIQLVNLISNAVNDTINVLPTITEGIPIVSTILDGINLGAAIKELLDE

HDPLLKKELEAKVGVLAINMSLSIAATVASIVGIGAEVTIFLLPIAGISAGIPSLVNNELILHDKATSVVNYF

NHLSESKKYGPLKTEDDKILVPIDDLVISEIDFNNNSIKLGTCNILAMEGGSGHTVTGNIDHFFSSPSISS

HIPSLSIYSAIGIETENLDFSKKIMMLPNAPSRVFWWETGAVPGLRSLENDGTRLLDSIRDLYPGKFYW

RFYAFFDYAITTLKPVYEDTNIKIKLDKDTRNFIMPTITTNEIRNKLSYSFDGAGGTYSLLLSSYPISTNIN

LSKDDLWIFNIDNEVREISIENGTIKKGKLIKDVLSKIDINKNKLIIGNQTIDFSGDIDNKDRYIFLTCELDD

KISLIIEINLVAKSYSLLLSGDKNYLISNLSNIIEKINTLGLDSKNIAYNYTDESNNKYFGAISKTSQKSIIHY

KKDSKNILEFYNDSTLEFNSKDFIAEDINVFMKDDINTITGKYYVDNNTDKSIDFSISLVSKNQVKVNGL

YLNESVYSSYLDFVKNSDGHHNTSNFMNLFLDNISFWKLFGFENINFVIDKYFTLVGKTNLGYVEFICD

NNKNIDIYFGEWKTSSSKSTIFSGNGRNVVVEPIYNPDTGEDISTSLDFSYEPLYGIDRYINKVLIAPDLY

TSLININTNYYSNEYYPEIIVLNPNTFHKKVNINLDSSSFEYKWSTEGSDFILVRYLEESNKKILQKIRIKGI

LSNTQSFNKMSIDFKDIKKLSLGYIMSNFKSFNSENELDRDHLGFKIIDNKTYYYDEDSKLVKGLININN

SLFYFDPIEFNLVTGWQTINGKKYYFDINTGAALISYKIINGKHFYFNNDGVMQLGVFKGPDGFEYFAP

ANTQNNNIEGQAIVYQSKFLTLNGKKYYFDNDSKAVTGWRIINNEKYYFNPNNAIAAVGLQVIDNNKYY

FNPDTAIISKGWQTVNGSRYYFDTDTAIAFNGYKTIDGKHFYFDSDCVVKIGVFSTSNGFEYFAPANTY

NNNIEGQAIVYQSKFLTLNGKKYYFDNNSKAVTGWQTIDSKKYYFNTNTAEAATGWQTIDGKKYYFNT

NTAEAATGWQTIDGKKYYFNTNTAIASTGYTIINGKHFYFNTDGIMQIGVFKGPNGFEYFAPANTDANN

IEGQAILYQNEFLTLNGKKYYFGSDSKAVTGWRIINNKKYYFNPNNAIAAIHLCTINNDKYYFSYDGILQ

NGYITIERNNFYFDANNESKMVTGVFKGPNGFEYFAPANTHNNNIEGQAIVYQNKFLTLNGKKYYFDN

DSKAVTGWQTIDGKKYYFNLNTAEAATGWQTIDGKKYYFNLNTAEAATGWQTIDGKKYYFNTNTFIA

STGYTSINGKHFYFNTDGIMQIGVFKGPNGFEYFAPANTHNNNIEGQAILYQNKFLTLNGKKYYFGSD

SKAVTGLRTIDGKKYYFNTNTAVAVTGWQTINGKKYYFNTNTSIASTGYTIISGKHFYFNTDGIMQIGVF

KGPDGFEYFAPANTDANNIEGQAIRYQNRFLYLHDNIYYFGNNSKAATGWVTIDGNRYYFEPNTAMG

ANGYKTIDNKNFYFRNGLPQIGVFKGSNGFEYFAPANTDANNIEGQAIRYQNRFLHLLGKIYYFGNNS

KAVTGWQTINGKVYYFMPDTAMAAAGGLFEIDGVIYFFGVDGVKAPGIYG

Toxin A-derived recombinant antigen - His-Thioredoxin-[thrombin site]-TxA3 SEQ ID 21

HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALVPRGSVTSLYKKAGSA

AAPFTMESKKYGPLKTEDDKILVPIDDLVISEIDFNNNSIKLGTCNILAMEGGSGHTVTGNIDHFFSSPSI

SSHIPSLSIYSAIGIETENLDFSKKIMMLPNAPSRVFWWETGAVPGLRSLENDGTRLLDSIRDLYPGKF

YWRFYAFFDYAITTLKPVYEDTNIKIKLDKDTRNFIMPTITTNEIRNKLSYSFDGAGGTYSLLLSSYPIST

NINLSKDDLWIFNIDNEVREISIENGTIKKGKLIKDVLSKIDINKNKLIIGNQTIDFSGDIDNKDRYIFLTCEL

DDKISLIIEINLVAKSYSLLLSGDKNYLISNLSNIIEKINTLGLDSKNIAYNYTDESNNKYFGAISKTSQKSII

HYKKDSKNILEFYNDSTLEFNSKDFIAEDINVFMKDDINTITGKYYVDNNTDKSIDFSISLVSKNQVKVN

GLYLNESVYSSYLDFVKNSDGHHNTSNFMNLFLDNISFWKLFGFENINFVIDKYFTLVGKTNLGYVEFI

```
CDNNKNIDIYFGEWKTSSSKSTIFSGNGRNVVVEPIYNPDTGEDISTSLDFSYEPLYGIDRYINKVLIAP

DLYTSLININTNYYSNEYYPEIIVLNPNTFHKKVNINLDSSSFEYKWSTEGSDFILVRYLEESNKKILQKIR

IKGILSNTQSFNKMSIDFKDIKKLSLGYIMSNFKSFNSENELDRDHLGFKIIDNKTYYYDEDSKLVKGLINI

NNSLFYFDPIEFNLVTGWQTINGKKYYFDINTGAALISYKIINGKHFYFNNDGVMQLGVFKGPDGFEYF

APANTQNNNIEGQAIVYQSKFLTLNGKKYYFDNDSKAVTGWRIINNEKYYFNPNNAIAAVGLQVIDNNK

YYFNPDTAIISKGWQTVNGSRYYFDTDTAIAFNGYKTIDGKHFYFDSDCVVKIGVFSTSNGFEYFAPAN

TYNNNIEGQAIVYQSKFLTLNGKKYYFDNNSKAVTGWQTIDSKKYYFNTNTAEAATGWQTIDGKKYYF

NTNTAEAATGWQTIDGKKYYFNTNTAIASTGYTIINGKHFYFNTDGIMQIGVFKGPNGFEYFAPANTDA

NNIEGQAILYQNEFLTLNGKKYYFGSDSKAVTGWRIINNKKYYFNPNNAIAAIHLCTINNDKYYFSYDGI

LQNGYITIERNNFYFDANNESKMVTGVFKGPNGFEYFAPANTHNNNIEGQAIVYQNKFLTLNGKKYYF

DNDSKAVTGWQTIDGKKYYFNLNTAEAATGWQTIDGKKYYFNLNTAEAATGWQTIDGKKYYFNTNTF

IASTGYTSINGKHFYFNTDGIMQIGVFKGPNGFEYFAPANTHNNNIEGQAILYQNKFLTLNGKKYYFGS

DSKAVTGLRTIDGKKYYFNTNTAVAVTGWQTINGKKYYFNTNTSIASTGYTIISGKHFYFNTDGIMQIG

VFKGPDGFEYFAPANTDANNIEGQAIRYQNRFLYLHDNIYYFGNNSKAATGWVTIDGNRYYFEPNTA

MGANGYKTIDNKNFYFRNGLPQIGVFKGSNGFEYFAPANTDANNIEGQAIRYQNRFLHLLGKIYYFGN

NSKAVTGWQTINGKVYYFMPDTAMAAAGGLFEIDGVIYFFGVDGVKAPGIYG
```

Toxin A-derived recombinant antigen - His-NusA-[thrombin site]-TxA3    SEQ ID 22

```
HHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAERAMVV

DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALVPRGSVTSLYKKAGSAAAPFTMESKKYGPLKTEDDKILV

PIDDLVISEIDFNNNSIKLGTCNILAMEGGSGHTVTGNIDHFFSSPSISSHIPSLSIYSAIGIETENLDFSKK

IMMLPNAPSRVFWWETGAVPGLRSLENDGTRLLDSIRDLYPGKFYWRFYAFFDYAITTLKPVYEDTNI

KIKLDKDTRNFIMPTITTNEIRNKLSYSFDGAGGTYSLLLSSYPISTNINLSKDDLWIFNIDNEVREISIEN

GTIKKGKLIKDVLSKIDINKNKLIIGNQTIDFSGDIDNKDRYIFLTCELDDKISLIIEINLVAKSYSLLLSGDK

NYLISNLSNIIEKINTLGLDSKNIAYNYTDESNNKYFGAISKTSQKSIIHYKKDSKNILEFYNDSTLEFNSK

DFIAEDINVFMKDDINTITGKYYVDNNTDKSIDFSISLVSKNQVKVNGLYLNESVYSSYLDFVKNSDGH

HNTSNFMNLFLDNISFWKLFGFENINFVIDKYFTLVGKTNLGYVEFICDNNKNIDIYFGEWKTSSSKSTI

FSGNGRNVVVEPIYNPDTGEDISTSLDFSYEPLYGIDRYINKVLIAPDLYTSLININTNYYSNEYYPEIIVL

NPNTFHKKVNINLDSSSFEYKWSTEGSDFILVRYLEESNKKILQKIRIKGILSNTQSFNKMSIDFKDIKKL

SLGYIMSNFKSFNSENELDRDHLGFKIIDNKTYYYDEDSKLVKGLININNSLFYFDPIEFNLVTGWQTIN

GKKYYFDINTGAALISYKIINGKHFYFNNDGVMQLGVFKGPDGFEYFAPANTQNNNIEGQAIVYQSKFL

TLNGKKYYFDNDSKAVTGWRIINNEKYYFNPNNAIAAVGLQVIDNNKYYFNPDTAIISKGWQTVNGSR

YYFDTDTAIAFNGYKTIDGKHFYFDSDCVVKIGVFSTSNGFEYFAPANTYNNNIEGQAIVYQSKFLTLN

GKKYYFDNNSKAVTGWQTIDSKKYYFNTNTAEAATGWQTIDGKKYYFNTNTAEAATGWQTIDGKKY

YFNTNTAIASTGYTIINGKHFYFNTDGIMQIGVFKGPNGFEYFAPANTDANNIEGQAILYQNEFLTLNGK
```

-continued

KYYFGSDSKAVTGWRIINNKKYYFNPNNAIAAIHLCTINNDKYYFSYDGILQNGYITIERNNFYFDANNE

SKMVTGVFKGPNGFEYFAPANTHNNNIEGQAIVYQNKFLTLNGKKYYFDNDSKAVTGWQTIDGKKYY

FNLNTAEAATGWQTIDGKKYYFNLNTAEAATGWQTIDGKKYYFNTNTFIASTGYTSINGKHFYFNTDGI

MQIGVFKGPNGFEYFAPANTHNNNIEGQAILYQNKFLTLNGKKYYFGSDSKAVTGLRTIDGKKYYFNT

NTAVAVTGWQTINGKKYYFNTNTSIASTGYTIISGKHFYFNTDGIMQIGVFKGPDGFEYFAPANTDANN

IEGQAIRYQNRFLYLHDNIYYFGNNSKAATGWVTIDGNRYYFEPNTAMGANGYKTIDNKNFYFRNGLP

QIGVFKGSNGFEYFAPANTDANNIEGQAIRYQNRFLHLLGKIYYFGNNSKAVTGWQTINGKVYYFMPD

TAMAAAGGLFEIDGVIYFFGVDGVKAPGIYG

Toxin B-derived recombinant antigen - His-NusA-[thrombin site]-TxB4-His    SEQ ID 23

HHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAAERAMVV

DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALVPRGSVTSLYKKAGSAAAPFTMSIIKDISSKEYISFNPKE

NKITVKSKNLPELSTLLQEIRNNSNSSDIELEEKVMLTECEINVISNIDTQIVEERIEEAKNLTSDSINYIKD

EFKLIESISDALCDLKQQNELEDSHFISFEDISETDEGFSIRFINKETGESIFVETEKTIFSEYANHITEEIS

KIKGTIFDTVNGKLVKKVNLDTTHEVNTLNAAFFIQSLIEYNSSKESLSNLSVAMKVQVYAQLFSTGLNT

ITDAAKVVELVSTALDETIDLLPTLSEGLPIIATIIDGVSLGAAIKELSETSDPLLRQEIEAKIGIMAVNLTTA

TTAIITSSLGIASGFSILLVPLAGISAGIPSLVNNELVLRDKATKVVDYFKHVSLVETEGVFTLLDDKIMMP

QDDLVISEIDFNNNSIVLGKCEIWRMEGGSGHTVTDDIDHFFSAPSITYREPHLSIYDVLEVQKEELDLS

KDLMVLPNAPNRVFAWETGWTPGLRSLENDGTKLLDRIRDNYEGEFYWRYFAFIADALITTLKPRYED

TNIRINLDSNTRSFIVPIITTEYIREKLSYSFYGSGGTYALSLSQYNMGINIELSESDVWIIDVDNVVRDVT

IESDKIKKGDLIEGILSTLSIEENKIILNSHEINFSGEVNGSNGFVSLTFSILEGINAIIEVDLLSKSYKLLISG

ELKILMLNSNHIQQKIDYIGFNSELQKNIPYSFVDSEGKENGFINGSTKEGLFVSELPDVVLISKVYMDD

SKPSFGYYSNNLKDVKVITKDNVNILTGYYLKDDIKISLSLTLQDEKTIKLNSVHLDESGVAEILKFMNRK

GNTNTSDSLMSFLESMNIKSIFVNFLQSNIKFILDANFIISGTTSIGQFEFICDENDNIQPYFIKFNTLETN

YTLYVGNRQNMIVEPNYDLDDSGDISSTVINFSQKYLYGIDSCVNKVVISPNIYTDEINITPVYETNNTY

PEVIVLDANYINEKINVNINDLSIRYVWSNDGNDFILMSTSEENKVSQVKIRFVNVFKDKTLANKLSFNF

SDKQDVPVSEIILSFTPSYYEDGLIGYDLGLVSLYNEKFYINNFGMMVSGLIYINDSLYYFKPPVNNLITG

FVTVGDDKYYFNPINGGAASIGETIIDDKNYYFNQSGVLQTGVFSTEDGFKYFAPANTLDENLEGEAID

FTGKLIIDENIYYFDDNYRGAVEWKELDGEMHYFSPETGKAFKGLNQIGDYKYYFNSDGVMQKGFVSI

NDNKHYFDDSGVMKVGYTEIDGKHFYFAENGEMQIGVFNTEDGFKYFAHHNEDLGNEEGEEISYSGI

LNFNNKIYYFDDSFTAVVGWKDLEDGSKYYFDEDTAEAYIGLSLINDGQYYFNDDGIMQVGFVTINDK

VFYFSDSGIIESGVQNIDDNYFYIDDNGIVQIGVFDTSDGYKYFAPANTVNDNIYGQAVEYSGLRVGE

DVYYFGETYTIETGWIYDMENESDKYYFNPETKKACKGINLIDDIKYYFDEKGIMRTGLISFENNNYYF

NENGEMQFGYINIEDKMFYFGEDGVMQIGVFNTPDGFKYFAHQNTLDENFEGESINYTGWLDLDEKR

YYFTDEYIAATGSVIIDGEEYYFDPDTAQLVISEGHHHHHH

Toxin B-derived recombinant antigen - His-NusA-[thrombin site]-TxB4

SEQ ID 24

HHHHHHSHMASNKEILAVVEAVSNEKALPREKIFEALESALATATKKKYEQEIDVRVQIDRKSGDFDTF
RRWLVVDEVTQPTKEITLEAARYEDESLNLGDYVEDQIESVTFDRITTQTAKQVIVQKVREAERAMVV
DQFREHEGEIITGVVKKVNRDNISLDLGNNAEAVILREDMLPRENFRPGDRVRGVLYSVRPEARGAQL
FVTRSKPEMLIELFRIEVPEIGEEVIEIKAAARDPGSRAKIAVKTNDKRIDPVGACVGMRGARVQAVSTE
LGGERIDIVLWDDNPAQFVINAMAPADVASIVVDEDKHTMDIAVEAGNLAQAIGRNGQNVRLASQLSG
WELNVMTVDDLQAKHQAEAHAAIDTFTKYLDIDEDFATVLVEEGFSTLEELAYVPMKELLEIEGLDEPT
VEALRERAKNALATIAQAQEESLGDNKPADDLLNLEGVDRDLAFKLAARGVCTLEDLAEQGIDDLADI
EGLTDEKAGALIMAARNICWFGDEASGALVPRGSVTSLYKKAGSAAAPFTMSIIKDISSKEYISFNPKE
NKITVKSKNLPELSTLLQEIRNNSNSSDIELEEKVMLTECEINVISNIDTQIVEERIEEAKNLTSDSINYIKD
EFKLIESISDALCDLKQQNELEDSHFISFEDISETDEGFSIRFINKETGESIFVETEKTIFSEYANHITEEIS
KIKGTIFDTVNGKLVKKVNLDTTHEVNTLNAAFFIQSLIEYNSSKESLSNLSVAMKVQVYAQLFSTGLNT
ITDAAKVVELVSTALDETIDLLPTLSEGLPIIATIIDGVSLGAAIKELSETSDPLLRQEIEAKIGIMAVNLTTA
TTAIITSSLGIASGFSILLVPLAGISAGIPSLVNNELVLRDKATKVVDYFKHVSLVETEGVFTLLDDKIMMP
QDDLVISEIDFNNNSIVLGKCEIWRMEGGSGHTVTDDIDHFFSAPSITYREPHLSIYDVLEVQKEELDLS
KDLMVLPNAPNRVFAWETGWTPGLRSLENDGTKLLDRIRDNYEGEFYWRYFAFIADALITTLKPRYED
TNIRINLDSNTRSFIVPIITTEYIREKLSYSFYGSGGTYALSLSQYNMGINIELSESDVWIIDVDNVVRDVT
IESDKIKKGDLIEGILSTLSIEENKIILNSHEINFSGEVNGSNGFVSLTFSILEGINAIIEVDLLSKSYKLLISG
ELKILMLNSNHIQQKIDYIGFNSELQKNIPYSFVDSEGKENGFINGSTKEGLFVSELPDVVLISKVYMDD
SKPSFGYYSNNLKDVKVITKDNVNILTGYYLKDDIKISLSLTLQDEKTIKLNSVHLDESGVAEILKFMNRK
GNTNTSDSLMSFLESMNIKSIFVNFLQSNIKFILDANFIISGTTSIGQFEFICDENDNIQPYFIKFNTLETN
YTLYVGNRQNMIVEPNYDLDDSGDISSTVINFSQKYLYGIDSCVNKVVISPNIYTDEINITPVYETNNTY
PEVIVLDANYINEKINVNINDLSIRYVWSNDGNDFILMSTSEENKVSQVKIRFVNVFKDKTLANKLSFNF
SDKQDVPVSEIILSFTPSYYEDGLIGYDLGLVSLYNEKFYINNFGMMVSGLIYINDSLYYFKPPVNNLITG
FVTVGDDKYYFNPINGGAASIGETIIDDKNYYFNQSGVLQTGVFSTEDGFKYFAPANTLDENLEGEAID
FTGKLIIDENIYYFDDNYRGAVEWKELDGEMHYFSPETGKAFKGLNQIGDYKYYFNSDGVMQKGFVSI
NDNKHYFDDSGVMKVGYTEIDGKHFYFAENGEMQIGVFNTEDGFKYFAHHNEDLGNEEGEEISYSGI
LNFNNKIYYFDDSFTAVVGWKDLEDGSKYYFDEDTAEAYIGLSLINDGQYYFNDDGIMQVGFVTINDK
VFYFSDSGIIESGVQNIDDNYFYIDDNGIVQIGVFDTSDGYKYFAPANTVNDNIYGQAVEYSGLVRVGE
DVYYFGETYTIETGWIYDMENESDKYYFNPETKKACKGINLIDDIKYYFDEKGIMRTGLISFENNNYYF
NENGEMQFGYINIEDKMFYFGEDGVMQIGVFNTPDGFKYFAHQNTLDENFEGESINYTGWLDLDEKR
YYFTDEYIAATGSVIIDGEEYYFDPDTAQLVISE

Toxin B-derived recombinant antigen - His-Thioredoxin-[thrombin site]-TxB4

SEQ ID 25

HHHHHHSHMASDKIIHLTDDSFDTDVLKADGAILVDFWAEWCGPCKMIAPILDEIADEYQGKLTVAKL
NIDQNPGTAPKYGIRGIPTLLLFKNGEVAATKVGALSKGQLKEFLDANLARALVPRGSVTSLYKKAGSA
AAPFTMSIIKDISSKEYISFNPKENKITVKSKNLPELSTLLQEIRNNSNSSDIELEEKVMLTECEINVISNID
TQIVEERIEEAKNLTSDSINYIKDEFKLIESISDALCDLKQQNELEDSHFISFEDISETDEGFSIRFINKETG
ESIFVETEKTIFSEYANHITEEISKIKGTIFDTVNGKLVKKVNLDTTHEVNTLNAAFFIQSLIEYNSSKESL
SNLSVAMKVQVYAQLFSTGLNTITDAAKVVELVSTALDETIDLLPTLSEGLPIIATIIDGVSLGAAIKELSE
TSDPLLRQEIEAKIGIMAVNLTTATTAIITSSLGIASGFSILLVPLAGISAGIPSLVNNELVLRDKATKVVDY

-continued

```
FKHVSLVETEGVFTLLDDKIMMPQDDLVISEIDFNNNSIVLGKCEIWRMEGGSGHTVTDDIDHFFSAPS

ITYREPHLSIYDVLEVQKEELDLSKDLMVLPNAPNRVFAWETGWTPGLRSLENDGTKLLDRIRDNYEG

EFYVVRYFAFIADALITTLKPRYEDTNIRINLDSNTRSFIVPIITTEYIREKLSYSFYGSGGTYALSLSQYNM

GINIELSESDVWIIDVDNVVRDVTIESDKIKKGDLIEGILSTLSIEENKIILNSHEINFSGEVNGSNGFVSLT

FSILEGINAIIEVDLLSKSYKLLISGELKILMLNSNHIQQKIDYIGFNSELQKNIPYSFVDSEGKENGFINGS

TKEGLFVSELPDVVLISKVYMDDSKPSFGYYSNNLKDVKVITKDNVNILTGYYLKDDIKISLSLTLQDEK

TIKLNSVHLDESGVAEILKFMNRKGNTNTSDSLMSFLESMNIKSIFVNFLQSNIKFILDANFIISGTTSIGQ

FEFICDENDNIQPYFIKFNTLETNYTLYVGNRQNMIVEPNYDLDDSGDISSTVINFSQKYLYGIDSCVNK

VVISPNIYTDEINITPVYETNNTYPEVIVLDANYINEKINVNINDLSIRYVWSNDGNDFILMSTSEENKVSQ

VKIRFVNVFKDKTLANKLSFNFSDKQDVPVSEIILSFTPSYYEDGLIGYDLGLVSLYNEKFYINNFGMMV

SGLIYINDSLYYFKPPVNNLITGFVTVGDDKYYFNPINGGAASIGETIIDDKNYYFNQSGVLQTGVFSTE

DGFKYFAPANTLDENLEGEAIDFTGKLIIDENIYYFDDNYRGAVEWKELDGEMHYFSPETGKAFKGLN

QIGDYKYFNSDGVMQKGFVSINDNKHYFDDSGVMKVGYTEIDGKHFYFAENGEMQIGVFNTEDGF

KYFAHHNEDLGNEEGEEISYSGILNFNNKIYYFDDSFTAVVGWKDLEDGSKYYFDEDTAEAYIGLSLIN

DGQYYFNDDGIMQVGFVTINDKVFYFSDSGIIESGVQNIDDNFYIDDNGIVQIGVFDTSDGYKYFAPA

NTVNDNIYGQAVEYSGLVRVGEDVYYFGETYTIETGWIYDMENESDKYYFNPETKKACKGINLIDDIKY

YFDEKGIMRTGLISFENNNYYFNENGEMQFGYINIEDKMFYFGEDGVMQIGVFNTPDGFKYFAHQNT

LDENFEGESINYTGWLDLDEKRYYFTDEYIAATGSVIIDGEEYYFDPDTAQLVISE
```

Toxin B-derived recombinant antigen - His-NusA-[thrombin site]-TxB3                    SEQ ID 26

```
HHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAERAMVV

DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALVPRGSVTSLYKKAGSAAGGSMPQDDLVISEIDFNNNSIV

LGKCEIWRMEGGSGHTVTDDIDHFFSAPSITYREPHLSIYDVLEVQKEELDLSKDLMVLPNAPNRVFA

WETGWTPGLRSLENDGTKLLDRIRDNYEGEFYWRYFAFIADALITTLKPRYEDTNIRINLDSNTRSFIV

PIITTEYIREKLSYSFYGSGGTYALSLSQYNMGINIELSESDVWIIDVDNVVRDVTIESDKIKKGDLIEGIL

STLSIEENKIILNSHEINFSGEVNGSNGFVSLTFSILEGINAIIEVDLLSKSYKLLISGELKILMLNSNHIQQK

IDYIGFNSELQKNIPYSFVDSEGKENGFINGSTKEGLFVSELPDVVLISKVYMDDSKPSFGYYSNNLKD

VKVITKDNVNILTGYYLKDDIKISLSLTLQDEKTIKLNSVHLDESGVAEILKFMNRKGNTNTSDSLMSFLE

SMNIKSIFVNFLQSNIKFILDANFIISGTTSIGQFEFICDENDNIQPYFIKFNTLETNYTLYVGNRQNMIVE

PNYDLDDSGDISSTVINFSQKYLYGIDSCVNKVVISPNIYTDEINITPVYETNNTYPEVIVLDANYINEKIN

VNINDLSIRYVWSNDGNDFILMSTSEENKVSQVKIRFVNVFKDKTLANKLSFNFSDKQDVPVSEIILSFT

PSYYEDGLIGYDLGLVSLYNEKFYINNFGMMVSGLIYINDSLYYFKPPVNNLITGFVTVGDDKYYFNPIN

GGAASIGETIIDDKNYYFNQSGVLQTGVFSTEDGFKYFAPANTLDENLEGEAIDFTGKLIIDENIYYFDD

NYRGAVEWKELDGEMHYFSPETGKAFKGLNQIGDYKYFNSDGVMQKGFVSINDNKHYFDDSGVM

KVGYTEIDGKHFYFAENGEMQIGVFNTEDGFKYFAHHNEDLGNEEGEEISYSGILNFNNKIYYFDDSF

TAVVGWKDLEDGSKYYFDEDTAEAYIGLSLINDGQYYFNDDGIMQVGFVTINDKVFYFSDSGIIESGV
```

-continued

QNIDDNYFYIDDNGIVQIGVFDTSDGYKYFAPANTVNDNIYGQAVEYSGLVRVGEDVYYFGETYTIETG

WIYDMENESDKYYFNPETKKACKGINLIDDIKYYFDEKGIMRTGLISFENNNYYFNENGEMQFGYINIE

DKMFYFGEDGVMQIGVFNTPDGFKYFAHQNTLDENFEGESINYTGWLDLDEKRYYFTDEYIAATGSVI

IDGEEYYFDPDTAQLVISE

Toxin B-derived recombinant antigen - His-Thioredoxin-[thrombin site]-TxB3 (-hyd)
SEQ ID 27

HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALVPRGSVTSLYKKAGSA

AGGSMPQDDLVISEIDFNNNSIVLGKCEIWRMEGGSGHTVTDDIDHFFSAPSITYREPHLSIYDVLEVQ

KEELDLSKDLMVLPNAPNRVFAWETGWTPGLRSLENDGTKLLDRIRDNYEGEFYWRYFAFIADALITT

LKPRYEDTNIRINLDSNTRSFIVPIITTEYIREKLSYSFYGSGGTYALSLSQYNMGINIELSESDVWIIDVD

NVVRDVTIESDKIKKGDLIEGILSTLSIEENKIILNSHEINFSGEVNGSNGFVSLTFSILEGINAIIEVDLLSK

SYKLLISGELKILMLNSNHIQQKIDYIGFNSELQKNIPYSFVDSEGKENGFINGSTKEGLFVSELPDVVLI

SKVYMDDSKPSFGYYSNNLKDVKVITKDNVNILTGYYLKDDIKISLSLTLQDEKTIKLNSVHLDESGVAE

ILKFMNRKGNTNTSDSLMSFLESMNIKSIFVNFLQSNIKFILDANFIISGTTSIGQFEFICDENDNIQPYFIK

FNTLETNYTLYVGNRQNMIVEPNYDLDDSGDISSTVINFSQKYLYGIDSCVNKVVISPNIYTDEINITPVY

ETNNTYPEVIVLDANYINEKINVNINDLSIRYVWSNDGNDFILMSTSEENKVSQVKIRFVNVFKDKTLAN

KLSFNFSDKQDVPVSEIILSFTPSYYEDGLIGYDLGLVSLYNEKFYINNFGMMVSGLIYINDSLYYFKPP

VNNLITGFVTVGDDKYYFNPINGGAASIGETIIDDKNYYFNQSGVLQTGVFSTEDGFKYFAPANTLDEN

LEGEAIDFTGKLIIDENIYYFDDNYRGAVEWKELDGEMHYFSPETGKAFKGLNQIGDYKYYFNSDGVM

QKGFVSINDNKHYFDDSGVMKVGYTEIDGKHFYFAENGEMQIGVFNTEDGFKYFAHHNEDLGNEEG

EEISYSGILNFNNKIYYFDDSFTAVVGWKDLEDGSKYYFDEDTAEAYIGLSLINDGQYYFNDDGIMQVG

FVTINDKVFYFSDSGIIESGVQNIDDNYFYIDDNGIVQIGVFDTSDGYKYFAPANTVNDNIYGQAVEYSG

LVRVGEDVYYFGETYTIETGWIYDMENESDKYYFNPETKKACKGINLIDDIKYYFDEKGIMRTGLISFEN

NNYYFNENGEMQFGYINIEDKMFYFGEDGVMQIGVFNTPDGFKYFAHQNTLDENFEGESINYTGWLD

LDEKRYYFTDEYIAATGSVIIDGEEYYFDPDTAQLVISE

Toxin A-derived recombinant antigen - His-[linear spacer]-NusA-[thrombin site]-TxA4
SEQ ID 28

HHHHHHHHHGGSGGSGGSGGSGGSGGSGGSGGSGGSGGSHMASNKEILAVVEAVSNEKALPRE

KIFEALESALATATKKKYEQEIDVRVQIDRKSGDFDTFRRWLVVDEVTQPTKEITLEAARYEDESLNLG

DYVEDQIESVTFDRITTQTAKQVIVQKVREAERAMVVDQFREHEGEIITGVVKKVNRDNISLDLGNNAE

AVILREDMLPRENFRPGDRVRGVLYSVRPEARGAQLFVTRSKPEMLIELFRIEVPEIGEEVIEIKAAARD

PGSRAKIAVKTNDKRIDPVGACVGMRGARVQAVSTELGGERIDIVLWDDNPAQFVINAMAPADVASIV

VDEDKHTMDIAVEAGNLAQAIGRNGQNVRLASQLSGWELNVMTVDDLQAKHQAEAHAAIDTFTKYLD

IDEDFATVLVEEGFSTLEELAYVPMKELLEIEGLDEPTVEALRERAKNALATIAQAQEESLGDNKPADD

LLNLEGVDRDLAFKLAARGVCTLEDLAEQGIDDLADIEGLTDEKAGALIMAARNICWFGDEASGALVP

RGSVTSLYKKAGSAAAPFTMIMSDLSSKEYIFFDSIDNKLKAKSKNIPGLASISEDIKTLLLDASVSPDTK

FILNNLKLNIESSIGDYIYYEKLEPVKNIIHNSIDDLIDEFNLLENVSDELYELKKLNNLDEKYLISFEDISKN

NSTYSVRFINKSNGESVYVETEKEIFSKYSEHITKEISTIKNSIITDVNGNLLDNIQLDHTSQVNTLNAAFF

IQSLIDYSSNKDVLNDLSTSVKVQLYAQLFSTGLNTIYDSIQLVNLISNAVNDTINVLPTITEGIPIVSTILD

GINLGAAIKELLDEHDPLLKKELEAKVGVLAINMSLSIAATVASIVGIGAEVTIFLLPIAGISAGIPSLVNNE

LILHDKATSVVNYFNHLSESKKYGPLKTEDDKILVPIDDLVISEIDFNNNSIKLGTCNILAMEGGSGHTVT

-continued

```
GNIDHFFSSPSISSHIPSLSIYSAIGIETENLDFSKKIMMLPNAPSRVFWWETGAVPGLRSLENDGTRLL

DSIRDLYPGKFYWRFYAFFDYAITTLKPVYEDTNIKIKLDKDTRNFIMPTITTNEIRNKLSYSFDGAGGTY

SLLLSSYPISTNINLSKDDLWIFNIDNEVREISIENGTIKKGKLIKDVLSKIDINKNKLIIGNQTIDFSGDIDN

KDRYIFLTCELDDKISLIIEINLVAKSYSLLLSGDKNYLISNLSNIIEKINTLGLDSKNIAYNYTDESNNKYF

GAISKTSQKSIIHYKKDSKNILEFYNDSTLEFNSKDFIAEDINVFMKDDINTITGKYYVDNNTDKSIDFSIS

LVSKNQVKVNGLYLNESVYSSYLDFVKNSDGHHNTSNFMNLFLDNISFWKLFGFENINFVIDKYFTLV

GKTNLGYVEFICDNNKNIDIYFGEWKTSSSKSTIFSGNGRNVVVEPIYNPDTGEDISTSLDFSYEPLYGI

DRYINKVLIAPDLYTSLININTNYYSNEYYPEIIVLNPNTFHKKVNINLDSSSFEYKWSTEGSDFILVRYLE

ESNKKILQKIRIKGILSNTQSFNKMSIDFKDIKKLSLGYIMSNFKSFNSENELDRDHLGFKIIDNKTYYYD

EDSKLVKGLININNSLFYFDPIEFNLVTGWQTINGKKYYFDINTGAALISYKIINGKHFYFNNDGVMQLG

VPFKGPDGFEYFAPANTQNNNIEGQAIVYQSKFLTLNGKKYYFDNDSKAVTGWRIINNEKYYFNPNNAI

AAVGLQVIDNNKYYFNPDTAIISKGWQTVNGSRYYFDTDTAIAFNGYKTIDGKHFYFDSDCVVKIGVFS

TSNGFEYFAPANTYNNNIEGQAIVYQSKFLTLNGKKYYFDNNSKAVTGWQTIDSKKYYFNTNTAEEAT

GWQTIDGKKYYFNTNTAEAATGWQTIDGKKYYFNTNTAIASTGYTIINGKHFYFNTDGIMQIGVFKGPN

GFEYFAPANTDANNIEGQAILYQNEFLTLNGKKYYFGSDSKAVTGWRIINNKKYYFNPNNAIAAIHLCTI

NNDKYYFSYDGILQNGYITIERNNFYFDANNESKMVTGVFKGPNGFEYFAPANTHNNNIEGQAIVYQN

KFLTLNGKKYYFDNDSKAVTGWQTIDGKKYYFNLNTAEAATGWQTIDGKKYYFNLNTAEAATGWQTI

DGKKYYFNTNTFIASTGYTSINGKHFYFNTDGIMQIGVFKGPNGFEYFAPANTHNNNIEGQAILYQNKF

LTLNGKKYYFGSDSKAVTGLRTIDGKKYYFNTNTAVAVTGWQTINGKKYYFNTNTSIASTGYTIISGKH

FYFNTDGIMQIGVFKGPDGFEYFAPANTDANNIEGQAIRYQNRFLYLHDNIYYFGNNSKAATGWVTID

GNRYYFEPNTAMGANGYKTIDNKNFYFRNGLPQIGVFKGSNGFEYFAPANTDANNIEGQAIRYQNRF

LHLLGKIYYFGNNSKAVTGWQTINGKVYYFMPDTAMAAAGGLFEIDGVIYFFGVDGVKAPGIYG.

Toxin A-derived recombinant antigen - His-[helical spacer]-NusA-[thrombin site]-TxA4
                                                                       SEQ ID 29
HHHHHHHHHHGGSLAEAAAKEAAAKEAAAKEAAAKAAAGGSHMASNKEILAVVEAVSNEKA

LPREKIFEALESALATATKKKYEQEIDVRVQIDRKSGDFDTFRRWLVVDEVTQPTKEITLEAARYEDES

LNLGDYVEDQIESVTFDRITTQTAKQVIVQKVREAERAMVVDQFREHEGEIITGVVKKVNRDNISLDLG

NNAEAVILREDMLPRENFRPGDRVRGVLYSVRPEARGAQLFVTRSKPEMLIELFRIEVPEIGEEVIEIKA

AARDPGSRAKIAVKTNDKRIDPVGACVGMRGARVQAVSTELGGERIDIVLWDDNPAQFVINAMAPAD

VASIVVDEDKHTMDIAVEAGNLAQAIGRNGQNVRLASQLSGWELNVMTVDDLQAKHQAEAHAAIDTF

TKYLDIDEDFATVLVEEGFSTLEELAYVPMKELLEIEGLDEPTVEALRERAKNALATIAQAQEESLGDN

KPADDLLNLEGVDRDLAFKLAARGVCTLEDLAEQGIDDLADIEGLTDEKAGALIMAARNICWFGDEAS

GALVPRGSVTSLYKKAGSAAAPFTMIMSDLSSKEYIFFDSIDNKLKAKSKNIPGLASISEDIKTLLLDASV

SPDTKFILNNLKLNIESSIGDYIYYEKLEPVKNIIHNSIDDLIDEFNLLENVSDELYELKKLNNLDEKYLISF

EDISKNNSTYSVRFINKSNGESVYVETEKEIFSKYSEHITKEISTIKNSIITDVNGNLLDNIQLDHTSQVNT

LNAAFFIQSLIDYSSNKDVLNDLSTSVKVQLYAQLFSTGLNTIYDSIQLVNLISNAVNDTINVLPTITEGIPI

VSTILDGINLGAAIKELLDEHDPLLKKELEAKVGVLAINMSLSIAATVASIVGIGAEVTIFLLPIAGISAGIPS

LVNNELILHDKATSVVNYFNHLSESKKYGPLKTEDDKILVPIDDLVISEIDFNNNSIKLGTCNILAMEGGS

GHTVTGNIDHFFSSPSISSHIPSLSIYSAIGIETENLDFSKKIMMLPNAPSRVFWWETGAVPGLRSLEND

GTRLLDSIRDLYPGKFYWRFYAFFDYAITTLKPVYEDTNIKIKLDKDTRNFIMPTITTNEIRNKLSYSFDG

AGGTYSLLLSSYPISTNINLSKDDLWIFNIDNEVREISIENGTIKKGKLIKDVLSKIDINKNKLIIGNQTIDFS

GDIDNKDRYIFLTCELDDKISLIIEINLVAKSYSLLLSGDKNYLISNLSNIIEKINTLGLDSKNIAYNYTDESN
```

-continued

NKYFGAISKTSQKSIIHYKKDSKNILEFYNDSTLEFNSKDFIAEDINVFMKDDINTITGKYYVDNNTDKSI
DFSISLVSKNQVKVNGLYLNESVYSSYLDFVKNSDGHHNTSNFMNLFLDNISFWKLFGFENINFVIDKY
FTLVGKTNLGYVEFICDNNKNIDIYFGEWKTSSSKSTIFSGNGRNVVVEPIYNPDTGEDISTSLDFSYEP
LYGIDRYINKVLIAPDLYTSLININTNYYSNEYYPEIIVLNPNTFHKKVNINLDSSSFEYKWSTEGSDFILV
RYLEESNKKILQKIRIKGILSNTQSFNKMSIDFKDIKKLSLGYIMSNFKSFNSENELDRDHLGFKIIDNKTY
YYDEDSKLVKGLININNSLFYFDPIEFNLVTGWQTINGKKYYFDINTGAALISYKIINGKHFYFNNDGVM
QLGVFKGPDGFEYFAPANTQNNNIEGQAIVYQSKFLTLNGKKYYFDNDSKAVTGWRIINNEKYYFNPN
NAIAAVGLQVIDNNKYYFNPDTAIISKGWQTVNGSRYYFDTDTAIAFNGYKTIDGKHFYFDSDCVVKIG
VFSTSNGFEYFAPANTYNNNIEGQAIVYQSKFLTLNGKKYYFDNNSKAVTGWQTIDSKKYYFNTNTAE
AATGWQTIDGKKYYFNTNTAEAATGWQTIDGKKYYFNTNTAIASTGYTIINGKHFYFNTDGIMQIGVFK
GPNGFEYFAPANTDANNIEGQAILYQNEFLTLNGKKYYFGSDSKAVTGWRIINNKKYYFNPNNAIAAIH
LCTINNDKYYFSYDGILQNGYITIERNNFYFDANNESKMVTGVFKGPNGFEYFAPANTHNNNIEGQAIV
YQNKFLTLNGKKYYFDNDSKAVTGWQTIDGKKYYFNLNTAEAATGWQTIDGKKYYFNLNTAEAATG
WQTIDGKKYYFNTNTFIASTGYTSINGKHFYFNTDGIMQIGVFKGPNGFEYFAPANTHNNNIEGQAILY
QNKFLTLNGKKYYFGSDSKAVTGLRTIDGKKYYFNTNTAVAVTGWQTINGKKYYFNTNTSIASTGYTII
SGKHFYFNTDGIMQIGVFKGPDGFEYFAPANTDANNIEGQAIRYQNRFLYLHDNIYYFGNNSKAATG
WVTIDGNRYYFEPNTAMGANGYKTIDNKNFYFRNGLPQIGVFKGSNGFEYFAPANTDANNIEGQAIR
YQNRFLHLLGKIYYFGNNSKAVTGWQTINGKVYYFMPDTAMAAAGGLFEIDGVIYFFGVDGVKAPGIY
G

Toxin A-derived recombinant antigen - His-NusA-[linear spacer]-[thrombin site]-TxA4
SEQ ID 30
HHHHHHSHMASNKEILAVVEAVSNEKALPREKIFEALESALATATKKKYEQEIDVRVQIDRKSGDFDTF
RRWLVVDEVTQPTKEITLEAARYEDESLNLGDYVEDQIESVTFDRITTQTAKQVIVQKVREAERAMVV
DQFREHEGEIITGVVKKVNRDNISLDLGNNAEAVILREDMLPRENFRPGDRVRGVLYSVRPEARGAQL
FVTRSKPEMLIELFRIEVPEIGEEVIEIKAAARDPGSRAKIAVKTNDKRIDPVGACVGMRGARVQAVSTE
LGGERIDIVLWDDNPAQFVINAMAPADVASIVVDEDKHTMDIAVEAGNLAQAIGRNGQNVRLASQLSG
WELNVMTVDDLQAKHQAEAHAAIDTFTKYLDIDEDFATVLVEEGFSTLEELAYVPMKELLEIEGLDEPT
VEALRERAKNALATIAQAQEESLGDNKPADDLLNLEGVDRDLAFKLAARGVCTLEDLAEQGIDDLADI
EGLTDEKAGALIMAARNICWFGDEASGALGGSGGSGGSGGSGGSGGSGGSGGSLVPRGSGS
AAAPFTMIMSDLSSKEYIFFDSIDNKLKAKSKNIPGLASISEDIKTLLLDASVSPDTKFILNNLKLNIESSIG
DYIYYEKLEPVKNIIHNSIDDLIDEFNLLENVSDELYELKKLNNLDEKYLISFEDISKNNSTYSVRFINKSN
GESVYVETEKEIFSKYSEHITKEISTIKNSIITDVNGNLLDNIQLDHTSQVNTLNAAFFIQSLIDYSSNKDV
LNDLSTSVKVQLYAQLFSTGLNTIYDSIQLVNLISNAVNDTINVLPTITEGIPIVSTILDGINLGAAIKELLDE
HDPLLKKELEAKVGVLAINMSLSIAATVASIVGIGAEVTIFLLPIAGISAGIPSLVNNELILHDKATSVVNYF
NHLSESKKYGPLKTEDDKILVPIDDLVISEIDFNNNSIKLGTCNILAMEGGSGHTVTGNIDHFFSSPSISS
HIPSLSIYSAIGIETENLDFSKKIMMLPNAPSRVFWWETGAVPGLRSLENDGTRLLDSIRDLYPGKFYW
RFYAFFDYAITTLKPVYEDTNIKIKLDKDTRNFIMPTITTNEIRNKLSYSFDGAGGTYSLLLSSYPISTNIN
LSKDDLWIFNIDNEVREISIENGTIKKGKLIKDVLSKIDINKNKLIIGNQTIDFSGDIDNKDRYIFLTCELDD
KISLIIEINLVAKSYSLLLSGDKNYLISNLSNIIEKINTLGLDSKNIAYNYTDESNNKYFGAISKTSQKSIIHY
KKDSKNILEFYNDSTLEFNSKDFIAEDINVFMKDDINTITGKYYVDNNTDKSIDFSISLVSKNQVKVNGL
YLNESVYSSYLDFVKNSDGHHNTSNFMNLFLDNISFWKLFGFENINFVIDKYFTLVGKTNLGYVEFICD -continued

NNKNIDIYFGEWKTSSSKSTIFSGNGRNVVVEPIYNPDTGEDISTSLDFSYEPLYGIDRYINKVLIAPDLY

TSLININTNYYSNEYYPEIIVLNPNTFHKKVNINLDSSSFEYKWSTEGSDFILVRYLEESNKKILQKIRIKGI

LSNTQSFNKMSIDFKDIKKLSLGYIMSNFKSFNSENELDRDHLGFKIIDNKTYYYDEDSKLVKGLININN

SLFYFDPIEFNLVTGWQTINGKKYYFDINTGAALISYKIINGKHFYFNNDGVMQLGVFKGPDGFEYFAP

ANTQNNNIEGQAIVYQSKFLTLNGKKYYFDNDSKAVTGWRIINNEKYYFNPNNAIAAVGLQVIDNNKYY

FNPDTAIISKGWQTVNGSRYYFDTDTAIAFNGYKTIDGKHFYFDSDCVVKIGVFSTSNGFEYFAPANTY

NNNIEGQAIVYQSKFLTLNGKKYYFDNNSKAVTGWQTIDSKKYYFNTNTAEAATGWQTIDGKKYYFNT

NTAEAATGWQTIDGKKYYFNTNTAIASTGYTIINGKHFYFNTDGIMQIGVFKGPNGFEYFAPANTDANN

IEGQAILYQNEFLTLNGKKYYFGSDSKAVTGWRIINNKKYYFNPNNAIAAIHLCTINNDKYYFSYDGILQ

NGYITIERNNFYFDANNESKMVTGVFKGPNGFEYFAPANTHNNNIEGQAIVYQNKFLTLNGKKYYFDN

DSKAVTGWQTIDGKKYYFNLNTAEAATGWQTIDGKKYYFNLNTAEAATGWQTIDGKKYYFNTNTFIA

STGYTSINGKHFYFNTDGIMQIGVFKGPNGFEYFAPANTHNNNIEGQAILYQNKFLTLNGKKYYFGSD

SKAVTGLRTIDGKKYYFNTNTAVAVTGWQTINGKKYYFNTNTSIASTGYTIISGKHFYFNTDGIMQIGVF

KGPDGFEYFAPANTDANNIEGQAIRYQNRFLYLHDNIYYFGNNSKAATGWVTIDGNRYYFEPNTAMG

ANGYKTIDNKNFYFRNGLPQIGVFKGSNGFEYFAPANTDANNIEGQAIRYQNRFLHLLGKIYYFGNNS

KAVTGWQTINGKVYYFMPDTAMAAAGGLFEIDGVIYFFGVDGVKAPGIYG

Toxin A-derived recombinant antigen - His-NusA-[helical spacer]-[thrombin site]-TxA4
SEQ ID 31
HHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAERAMVV

DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALLAEAAAKEAAAKEAAAKEAAAKEAAAKAAAGGSLVPRG

SGSAAAPFTMIMSDLSSKEYIFFDSIDNKLKAKSKNIPGLASISEDIKTLLLDASVSPDTKFILNNLKLNIE

SSIGDYIYYEKLEPVKNIIHNSIDDLIDEFNLLENVSDELYELKKLNNLDEKYLISFEDISKNNSTYSVRFIN

KSNGESVYVETEKEIFSKYSEHITKEISTIKNSIITDVNGNLLDNIQLDHTSQVNTLNAAFFIQSLIDYSSN

KDVLNDLSTSVKVQLYAQLFSTGLNTIYDSIQLVNLISNAVNDTINVLPTITEGIPIVSTILDGINLGAAIKE

LLDEHDPLLKKELEAKVGVLAINMSLSIAATVASIVGIGAEVTIFLLPIAGISAGIPSLVNNELILHDKATSV

VNYFNHLSESKKYGPLKTEDDKILVPIDDLVISEIDFNNNSIKLGTCNILAMEGGSGHTVTGNIDHFFSS

PSISSHIPSLSIYSAIGIETENLDFSKKIMMLPNAPSRVFWWETGAVPGLRSLENDGTRLLDSIRDLYPG

KFYWRFYAFFDYAITTLKPVYEDTNIKIKLDKDTRNFIMPTITTNEIRNKLSYSFDGAGGTYSLLLSSYPI

STNINLSKDDLWIFNIDNEVREISIENGTIKKGKLIKDVLSKIDINKNKLIIGNQTIDFSGDIDNKDRYIFLTC

ELDDKISLIIEINLVAKSYSLLLSGDKNYLISNLSNIIEKINTLGLDSKNIAYNYTDESNNKYFGAISKTSQK

SIIHYKKDSKNILEFYNDSTLEFNSKDFIAEDINVFMKDDINTITGKYYVDNNTDKSIDFSISLVSKNQVKV

NGLYLNESVYSSYLDFVKNSDGHHNTSNFMNLFLDNISFWKLFGFENINFVIDKYFTLVGKTNLGYVE

FICDNNKNIDIYFGEWKTSSSKSTIFSGNGRNVVVEPIYNPDTGEDISTSLDFSYEPLYGIDRYINKVLIA

PDLYTSLININTNYYSNEYYPEIIVLNPNTFHKKVNINLDSSSFEYKWSTEGSDFILVRYLEESNKKILQKI

RIKGILSNTQSFNKMSIDFKDIKKLSLGYIMSNFKSFNSENELDRDHLGFKIIDNKTYYYDEDSKLVKGLI

NINNSLFYFDPIEFNLVTGWQTINGKKYYFDINTGAALISYKIINGKHFYFNNDGVMQLGVFKGPDGFE

YFAPANTQNNNIEGQAIVYQSKFLTLNGKKYYFDNDSKAVTGWRIINNEKYYFNPNNAIAAVGLQVIDN

NKYYFNPDTAIISKGWQTVNGSRYYFDTDTAIAFNGYKTIDGKHFYFDSDCVVKIGVFSTSNGFEYFAP

ANTYNNNIEGQAIVYQSKFLTLNGKKYYFDNNSKAVTGWQTIDSKKYYFNTNTAEAATGWQTIDGKK

YYFNTNTAEAATGWQTIDGKKYYFNTNTAIASTGYTIINGKHFYFNTDGIMQIGVFKGPNGFEYFAPAN

TDANNIEGQAILYQNEFLTLNGKKYYFGSDSKAVTGWRIINNKKYYFNPNNAIAAIHLCTINNDKYYFSY

DGILQNGYITIERNNFYFDANNESKMVTGVFKGPNGFEYFAPANTHNNNIEGQAIVYQNKFLTLNGKK

YYFDNDSKAVTGWQTIDGKKYYFNLNTAEAATGWQTIDGKKYYFNLNTAEAATGWQTIDGKKYYFNT

NTFIASTGYTSINGKHFYFNTDGIMQIGVFKGPNGFEYFAPANTHNNNIEGQAILYQNKFLTLNGKKYY

FGSDSKAVTGLRTIDGKKYYFNTNTAVAVTGWQTINGKKYYFNTNTSIASTGYTIISGKHFYFNTDGIM

QIGVFKGPDGFEYFAPANTDANNIEGQAIRYQNRFLYLHDNIYYFGNNSKAATGWVTIDGNRYYFEPN

TAMGANGYKTIDNKNFYFRNGLPQIGVFKGSNGFEYFAPANTDANNIEGQAIRYQNRFLHLLGKIYYF

GNNSKAVTGWQTINGKVYYFMPDTAMAAAGGLFEIDGVIYFFGVDGVKAPGIYG

Toxin A-derived recombinant antigen - His-[linear spacer]-NusA-[thrombin site]-TxA3

SEQ ID 32

HHHHHHHHHGGSGGSGGSGGSGGSGGSGGSGGSGGSHMASNKEILAVVEAVSNEKALPRE

KIFEALESALATATKKKYEQEIDVRVQIDRKSGDFDTFRRWLVVDEVTQPTKEITLEAARYEDESLNLG

DYVEDQIESVTFDRITTQTAKQVIVQKVREAERAMVVDQFREHEGEIITGVVKKVNRDNISLDLGNNAE

AVILREDMLPRENFRPGDRVRGVLYSVRPEARGAQLFVTRSKPEMLIELFRIEVPEIGEEVIEIKAAARD

PGSRAKIAVKTNDKRIDPVGACVGMRGARVQAVSTELGGERIDIVLWDDNPAQFVINAMAPADVASIV

VDEDKHTMDIAVEAGNLAQAIGRNGQNVRLASQLSGWELNVMTVDDLQAKHQAEAHAAIDTFTKYLD

IDEDFATVLVEEGFSTLEELAYVPMKELLEIEGLDEPTVEALRERAKNALATIAQAQEESLGDNKPADD

LLNLEGVDRDLAFKLAARGVCTLEDLAEQGIDDLADIEGLTDEKAGALIMAARNICWFGDEASGALVP

RGSVTSLYKKAGSAAAPFTMESKKYGPLKTEDDKILVPIDDLVISEIDFNNNSIKLGTCNILAMEGGSGH

TVTGNIDHFFSSPSISSHIPSLSIYSAIGIETENLDFSKKIMMLPNAPSRVFWWETGAVPGLRSLENDGT

RLLDSIRDLYPGKFYWRFYAFFDYAITTLKPVYEDTNIKIKLDKDTRNFIMPTITTNEIRNKLSYSFDGAG

GTYSLLLSSYPISTNINLSKDDLWIFNIDNEVREISIENGTIKKGKLIKDVLSKIDINKNKLIIGNQTIDFSGD

IDNKDRYIFLTCELDDKISLIIEINLVAKSYSLLLSGDKNYLISNLSNIIEKINTLGLDSKNIAYNYTDESNNK

YFGAISKTSQKSIIHYKKDSKNILEFYNDSTLEFNSKDFIAEDINVFMKDDINTITGKYYVDNNTDKSIDFS

ISLVSKNQVKVNGLYLNESVYSSYLDFVKNSDGHHNTSNFMNLFLDNISFWKLFGFENINFVIDKYFTL

VGKTNLGYVEFICDNNKNIDIYFGEWKTSSSKSTIFSGNGRNVVVEPIYNPDTGEDISTSLDFSYEPLY

GIDRYINKVLIAPDLYTSLININTNYYSNEYYPEIIVLNPNTFHKKVNINLDSSSFEYKWSTEGSDFILVRY

LEESNKKILQKIRIKGILSNTQSFNKMSIDFKDIKKLSLGYIMSNFKSFNSENELDRDHLGFKIIDNKTYYY

DEDSKLVKGLININNSLFYFDPIEFNLVTGWQTINGKKYYFDINTGAALISYKIINGKHFYFNNDGVMQL

GVFKGPDGFEYFAPANTQNNNIEGQAIVYQSKFLTLNGKKYYFDNDSKAVTGWRIINNEKYYFNPNN

AIAAVGLQVIDNNKYYFNPDTAIISKGWQTVNGSRYYFDTDTAIAFNGYKTIDGKHFYFDSDCVVKIGV

FSTSNGFEYFAPANTYNNNIEGQAIVYQSKFLTLNGKKYYFDNNSKAVTGWQTIDSKKYYFNTNTAEA

ATGWQTIDGKKYYFNTNTAEAATGWQTIDGKKYYFNTNTAIASTGYTIINGKHFYFNTDGIMQIGVFKG

PNGFEYFAPANTDANNIEGQAILYQNEFLTLNGKKYYFGSDSKAVTGWRIINNKKYYFNPNNAIAAIHL

CTINNDKYYFSYDGILQNGYITIERNNFYFDANNESKMVTGVFKGPNGFEYFAPANTHNNNIEGQAIVY

QNKFLTLNGKKYYFDNDSKAVTGWQTIDGKKYYFNLNTAEAATGWQTIDGKKYYFNLNTAEAATGW

QTIDGKKYYFNTNTFIASTGYTSINGKHFYFNTDGIMQIGVFKGPNGFEYFAPANTHNNNIEGQAILYQ

```
                                      -continued
NKFLTLNGKKYYFGSDSKAVTGLRTIDGKKYYFNTNTAVAVTGWQTINGKKYYFNTNTSIASTGYTIIS

GKHFYFNTDGIMQIGVFKGPDGFEYFAPANTDANNIEGQAIRYQNRFLYLHDNIYYFGNNSKAATGW

VTIDGNRYYFEPNTAMGANGYKTIDNKNFYFRNGLPQIGVFKGSNGFEYFAPANTDANNIEGQAIRYQ

NRFLHLLGKIYYFGNNSKAVTGWQTINGKVYYFMPDTAMAAAGGLFEIDGVIYFFGVDGVKAPGIYG

Toxin A-derived recombinant antigen - His-[helical spacer]-NusA-[thrombin site]-TxA3
                                                                                      SEQ ID 33
HHHHHHHHHHGGSLAEAAAKEAAAKEAAAKEAAAKEAAAKAAAGGSHMASNKEILAVVEAVSNEKA

LPREKIFEALESALATATKKKYEQEIDVRVQIDRKSGDFDTFRRWLVVDEVTQPTKEITLEAARYEDES

LNLGDYVEDQIESVTFDRITTQTAKQVIVQKVREAERAMVVDQFREHEGEIITGVVKKVNRDNISLDLG

NNAEAVILREDMLPRENFRPGDRVRGVLYSVRPEARGAQLFVTRSKPEMLIELFRIEVPEIGEEVIEIKA

AARDPGSRAKIAVKTNDKRIDPVGACVGMRGARVQAVSTELGGERIDIVLWDDNPAQFVINAMAPAD

VASIVVDEDKHTMDIAVEAGNLAQAIGRNGQNVRLASQLSGWELNVMTVDDLQAKHQAEAHAAIDTF

TKYLDIDEDFATVLVEEGFSTLEELAYVPMKELLEIEGLDEPTVEALRERAKNALATIAQAQEESLGDN

KPADDLLNLEGVDRDLAFKLAARGVCTLEDLAEQGIDDLADIEGLTDEKAGALIMAARNICWFGDEAS

GALVPRGSVTSLYKKAGSAAAPFTMESKKYGPLKTEDDKILVPIDDLVISEIDFNNNSIKLGTCNILAME

GGSGHTVTGNIDHFFSSPSISSHIPSLSIYSAIGIETENLDFSKKIMMLPNAPSRVFWWETGAVPGLRS

LENDGTRLLDSIRDLYPGKFYWRFYAFFDYAITTLKPVYEDTNIKIKLDKDTRNFIMPTITTNEIRNKLSY

SFDGAGGTYSLLLSSYPISTNINLSKDDLWIFNIDNEVREISIENGTIKKGKLIKDVLSKIDINKNKLIIGNQ

TIDFSGDIDNKDRYIFLTCELDDKISLIIEINLVAKSYSLLLSGDKNYLISNLSNIIEKINTLGLDSKNIAYNYT

DESNNKYFGAISKTSQKSIIHYKKDSKNILEFYNDSTLEFNSKDFIAEDINVFMKDDINTITGKYYVDNNT

DKSIDFSISLVSKNQVKVNGLYLNESVYSSYLDFVKNSDGHHNTSNFMNLFLDNISFWKLFGFENINFV

IDKYFTLVGKTNLGYVEFICDNNKNIDIYFGEWKTSSSKSTIFSGNGRNVVVEPIYNPDTGEDISTSLDF

SYEPLYGIDRYINKVLIAPDLYTSLININTNYYSNEYYPEIIVLNPNTFHKKVNINLDSSSFEYKWSTEGS

DFILVRYLEESNKKILQKIRIKGILSNTQSFNKMSIDFKDIKKLSLGYIMSNFKSFNSENELDRDHLGFKII

DNKTYYYDEDSKLVKGLININNSLFYFDPIEFNLVTGWQTINGKKYYFDINTGAALISYKIINGKHFYFNN

DGVMQLGVFKGPDGFEYFAPANTQNNNIEGQAIVYQSKFLTLNGKKYYFDNDSKAVTGWRIINNEKY

YFNPNNAIAAVGLQVIDNNKYYFNPDTAIISKGWQTVNGSRYYFDTDTAIAFNGYKTIDGKHFYFDSDC

VVKIGVFSTSNGFEYFAPANTYNNNIEGQAIVYQSKFLTLNGKKYYFDNNSKAVTGWQTIDSKKYYFN

TNTAEAATGWQTIDGKKYYFNTNTAEAATGWQTIDGKKYYFNTNTAIASTGYTIINGKHFYFNTDGIM

QIGVFKGPNGFEYFAPANTDANNIEGQAILYQNEFLTLNGKKYYFGSDSKAVTGWRIINNKKYYFNPN

NAIAAIHLCTINNDKYYFSYDGILQNGYITIERNNFYFDANNESKMVTGVFKGPNGFEYFAPANTHNNNI

EGQAIVYQNKFLTLNGKKYYFDNDSKAVTGWQTIDGKKYYFNLTAEAATGWQTIDGKKYYFNLNTA

EAATGWQTIDGKKYYFNTNTFIASTGYTSINGKHFYFNTDGIMQIGVFKGPNGFEYFAPANTHNNNIE

GQAILYQNKFLTLNGKKYYFGSDSKAVTGLRTIDGKKYYFNTNTAVAVTGWQTINGKKYYFNTNTSIA

STGYTIISGKHFYFNTDGIMQIGVFKGPDGFEYFAPANTDANNIEGQAIRYQNRFLYLHDNIYYFGNNS

KAATGWVTIDGNRYYFEPNTAMGANGYKTIDNKNFYFRNGLPQIGVFKGSNGFEYFAPANTDANNIE

GQAIRYQNRFLHLLGKIYYFGNNSKAVTGWQTINGKVYYFMPDTAMAAAGGLFEIDGVIYFFGVDGVK

APGIYG

Toxin A-derived recombinant antigen - His-NusA-[linear spacer]-[thrombin site]-TxA3
                                                                                     SEQ ID 34
HHHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAERAMVV
```

```
DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALGGSGGSGGSGGSGGSGGSGGSGGSLVPRGSGS

AAAPFTMESKKYGPLKTEDDKILVPIDDLVISEIDFNNNSIKLGTCNILAMEGGSGHTVTGNIDHFFSSP

SISSHIPSLSIYSAIGIETENLDFSKKIMMLPNAPSRVFWWETGAVPGLRSLENDGTRLLDSIRDLYPGK

FYWRFYAFFDYAITTLKPVYEDTNIKIKLDKDTRNFIMPTITTNEIRNKLSYSFDGAGGTYSLLLSSYPIS

TNINLSKDDLWIFNIDNEVREISIENGTIKKGKLIKDVLSKIDINKNKLIIGNQTIDFSGDIDNKDRYIFLTCE

LDDKISLIIEINLVAKSYSLLLSGDKNYLISNLSNIIEKINTLGLDSKNIAYNYTDESNNKYFGAISKTSQKSI

IHYKKDSKNILEFYNDSTLEFNSKDFIAEDINVFMKDDINTITGKYYVDNNTDKSIDFSISLVSKNQVKVN

GLYLNESVYSSYLDFVKNSDGHHNTSNFMNLFLDNISFWKLFGFENINFVIDKYFTLVGKTNLGYVEFI

CDNNKNIDIYFGEWKTSSSKSTIFSGNGRNVVVEPIYNPDTGEDISTSLDFSYEPLYGIDRYINKVLIAP

DLYTSLININTNYYSNEYYPEIIVLNPNTFHKKVNINLDSSSFEYKWSTEGSDFILVRYLEESNKKILQKIR

IKGILSNTQSFNKMSIDFKDIKKLSLGYIMSNFKSFNSENELDRDHLGFKIIDNKTYYYDEDSKLVKGLINI

NNSLFYFDPIEFNLVTGWQTINGKKYYFDINTGAALISYKIINGKHFYFNNDGVMQLGVFKGPDGFEYF

APANTQNNNIEGQAIVYQSKFLTLNGKKYYFDNDSKAVTGWRIINNEKYYFNPNNAIAAVGLQVIDNNK

YYFNPDTAIISKGWQTVNGSRYYFDTDTAIAFNGYKTIDGKHFYFDSDCVVKIGVFSTSNGFEYFAPAN

TYNNNIEGQAIVYQSKFLTLNGKKYYFDNNSKAVTGWQTIDSKKYYFNTNTAEAATGWQTIDGKKYYF

NTNTAEAATGWQTIDGKKYYFNTNTAIASTGYTIINGKHFYFNTDGIMQIGVFKGPNGFEYFAPANTDA

NNIEGQAILYQNEFLTLNGKKYYFGSDSKAVTGWRIINNKKYYFNPNNAIAAIHLCTINNDKYYFSYDGI

LQNGYITIERNNFYFDANNESKMVTGVFKGPNGFEYFAPANTHNNNIEGQAIVYQNKFLTLNGKKYYF

DNDSKAVTGWQTIDGKKYYFNLNTAEAATGWQTIDGKKYYFNLNTAEAATGWQTIDGKKYYFNTNTF

IASTGYTSINGKHFYFNTDGIMQIGVFKGPNGFEYFAPANTHNNNIEGQAILYQNKFLTLNGKKYYFGS

DSKAVTGLRTIDGKKYYFNTNTAVAVTGWQTINGKKYYFNTNTSIASTGYTIISGKHFYFNTDGIMQIG

VFKGPDGFEYFAPANTDANNIEGQAIRYQNRFLYLHDNIYYFGNNSKAATGWVTIDGNRYYFEPNTA

MGANGYKTIDNKNFYFRNGLPQIGVFKGSNGFEYFAPANTDANNIEGQAIRYQNRFLHLLGKIYYFGN

NSKAVTGWQTINGKVYYFMPDTAMAAAGGLFEIDGVIYFFGVDGVKAPGIYG

Toxin A-derived recombinant antigen - His-NusA-[helical spacer]-[thrombin site]-TxA3
                                                                           SEQ ID 35
HHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAERAMV

DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALLAEAAAKEAAAKEAAAKEAAAKEAAAKAAAGGSLVPRG

SGSAAAPFTMESKKYGPLKTEDDKILVPIDDLVISEIDFNNNSIKLGTCNILAMEGGSGHTVTGNIDHFF

SSPSISSHIPSLSIYSAIGIETENLDFSKKIMMLPNAPSRVFWWETGAVPGLRSLENDGTRLLDSIRDLY

PGKFYWRFYAFFDYAITTLKPVYEDTNIKIKLDKDTRNFIMPTITTNEIRNKLSYSFDGAGGTYSLLLSSY
```

```
PISTNINLSKDDLWIFNIDNEVREISIENGTIKKGKLIKDVLSKIDINKNKLIIGNQTIDFSGDIDNKDRYIFLT

CELDDKISLIIEINLVAKSYSLLLSGDKNYLISNLSNIIEKINTLGLDSKNIAYNYTDESNNKYFGAISKTSQ

KSIIHYKKDSKNILEFYNDSTLEFNSKDFIAEDINVFMKDDINTITGKYYVDNNTDKSIDFSISLVSKNQVK

VNGLYLNESVYSSYLDFVKNSDGHHNTSNFMNLFLDNISFWKLFGFENINFVIDKYFTLVGKTNLGYV

EFICDNNKNIDIYFGEWKTSSSKSTIFSGNGRNVVVEPIYNPDTGEDISTSLDFSYEPLYGIDRYINKVLI

APDLYTSLININTNYYSNEYYPEIIVLNPNTFHKKVNINLDSSSFEYKWSTEGSDFILVRYLEESNKKILQ

KIRIKGILSNTQSFNKMSIDFKDIKKLSLGYIMSNFKSFNSENELDRDHLGFKIIDNKTYYYDEDSKLVKG

LININNSLFYFDPIEFNLVTGWQTINGKKYYFDINTGAALISYKIINGKHFYFNNDGVMQLGVFKGPDGF

EYFAPANTQNNNIEGQAIVYQSKFLTLNGKKYYFDNDSKAVTGWRIINNEKYYFNPNNAIAAVGLQVID

NNKYYFNPDTAIISKGWQTVNGSRYYFDTDTAIAFNGYKTIDGKHFYFDSDCVVKIGVFSTSNGFEYF

APANTYNNNIEGQAIVYQSKFLTLNGKKYYFDNNSKAVTGWQTIDSKKYYFNTNTAEAATGWQTIDG

KKYYFNTNTAEAATGWQTIDGKKYYFNTNTAIASTGYTIINGKHFYFNTDGIMQIGVFKGPNGFEYFAP

ANTDANNIEGQAILYQNEFLTLNGKKYYFGSDSKAVTGWRIINNKKYYFNPNNAIAAIHLCTINNDKYYF

SYDGILQNGYITIERNNFYFDANNESKMVTGVFKGPNGFEYFAPANTHNNNIEGQAIVYQNKFLTLNG

KKYYFDNDSKAVTGWQTIDGKKYYFNLNTAEAATGWQTIDGKKYYFNLNTAEAATGWQTIDGKKYYF

NTNTFIASTGYTSINGKHFYFNTDGIMQIGVFKGPNGFEYFAPANTHNNNIEGQAILYQNKFLTLNGKK

YYFGSDSKAVTGLRTIDGKKYYFNTNTAVAVTGWQTINGKKYYFNTNTSIASTGYTIISGKHFYFNTDG

IMQIGVFKGPDGFEYFAPANTDANNIEGQAIRYQNRFLYLHDNIYYFGNNSKAATGWVTIDGNRYYFE

PNTAMGANGYKTIDNKNFYFRNGLPQIGVFKGSNGFEYFAPANTDANNIEGQAIRYQNRFLHLLGKIY

YFGNNSKAVTGWQTINGKVYYFMPDTAMAAAGGLFEIDGVIYFFGVDGVKAPGIYG

Toxin A-derived recombinant antigen - His-[linear spacer]-Thioredoxin-
[thrombin site]-TxA4                                                SEQ ID 36

HHHHHHHHHHGGSGGSGGSGGSGGSGGSGGSGGSGGSGGSHMASDKIIHLTDDSFDTDVLKADGA

ILVDFWAEWCGPCKMIAPILDEIADEYQGKLTVAKLNIDQNPGTAPKYGIRGIPTLLLFKNGEVAATKVG

ALSKGQLKEFLDANLARALVPRGSVTSLYKKAGSAAAPFTMIMSDLSSKEYIFFDSIDNKLKAKSKNIP

GLASISEDIKTLLLDASVSPDTKFILNNLKLNIESSIGDYIYYEKLEPVKNIIHNSIDDLIDEFNLLENVSDEL

YELKKLNNLDEKYLISFEDISKNNSTYSVRFINKSNGESVYVETEKEIFSKYSEHITKEISTIKNSIITDVN

GNLLDNIQLDHTSQVNTLNAAFFIQSLIDYSSNKDVLNDLSTSVKVQLYAQLFSTGLNTIYDSIQLVNLIS

NAVNDTINVLPTITEGIPIVSTILDGINLGAAIKELLDEHDPLLKKELEAKVGVLAINMSLSIAATVASIVGIG

AEVTIFLLPIAGISAGIPSLVNNELILHDKATSVVNYFNHLSESKKYGPLKTEDDKILVPIDDLVISEIDFNN

NSIKLGTCNILAMEGGSGHTVTGNIDHFFSSPSISSHIPSLSIYSAIGIETENLDFSKKIMMLPNAPSRVF

WWETGAVPGLRSLENDGTRLLDSIRDLYPGKFYWRFYAFFDYAITTLKPVYEDTNIKIKLDKDTRNFIM

PTITTNEIRNKLSYSFDGAGGTYSLLLSSYPISTNINLSKDDLWIFNIDNEVREISIENGTIKKGKLIKDVLS

KIDINKNKLIIGNQTIDFSGDIDNKDRYIFLTCELDDKISLIIEINLVAKSYSLLLSGDKNYLISNLSNIIEKINT

LGLDSKNIAYNYTDESNNKYFGAISKTSQKSIIHYKKDSKNILEFYNDSTLEFNSKDFIAEDINVFMKDDI

NTITGKYYVDNNTDKSIDFSISLVSKNQVKVNGLYLNESVYSSYLDFVKNSDGHHNTSNFMNLFLDNIS

FWKLFGFENINFVIDKYFTLVGKTNLGYVEFICDNNKNIDIYFGEWKTSSSKSTIFSGNGRNVVVEPIYN

PDTGEDISTSLDFSYEPLYGIDRYINKVLIAPDLYTSLININTNYYSNEYYPEIIVLNPNTFHKKVNINLDS

SSFEYKWSTEGSDFILVRYLEESNKKILQKIRIKGILSNTQSFNKMSIDFKDIKKLSLGYIMSNFKSFNSE

NELDRDHLGFKIIDNKTYYYDEDSKLVKGLININNSLFYFDPIEFNLVTGWQTINGKKYYFDINTGAALIS

YKIINGKHFYFNNDGVMQLGVFKGPDGFEYFAPANTQNNNIEGQAIVYQSKFLTLNGKKYYFDNDSKA
```

-continued

```
VTGWRIINNEKYYFNPNNAIAAVGLQVIDNNKYYFNPDTAIISKGWQTVNGSRYYFDTDTAIAFNGYKTI

DGKHFYFDSDCVVKIGVFSTSNGFEYFAPANTYNNNIEGQAIVYQSKFLTLNGKKYYFDNNSKAVTG

WQTIDSKKYYFNTNTAEAATGWQTIDGKKYYFNTNTAEAATGWQTIDGKKYYFNTNTAIASTGYTIIN

GKHFYFNTDGIMQIGVFKGPNGFEYFAPANTDANNIEGQAILYQNEFLTLNGKKYYFGSDSKAVTGW

RIINNKKYYFNPNNAIAAIHLCTINNDKYYFSYDGILQNGYITIERNNFYFDANNESKMVTGVFKGPNGF

EYFAPANTHNNNIEGQAIVYQNKFLTLNGKKYYFDNDSKAVTGWQTIDGKKYYFNLNTAEAATGWQTI

DGKKYYFNLNTAEAATGWQTIDGKKYYFNTNTFIASTGYTSINGKHFYFNTDGIMQIGVFKGPNGFEY

FAPANTHNNNIEGQAILYQNKFLTLNGKKYYFGSDSKAVTGLRTIDGKKYYFNTNTAVAVTGWQTING

KKYYFNTNTSIASTGYTIISGKHFYFNTDGIMQIGVFKGPDGFEYFAPANTDANNIEGQAIRYQNRFLYL

HDNIYYFGNNSKAATGWVTIDGNRYYFEPNTAMGANGYKTIDNKNFYFRNGLPQIGVFKGSNGFEYF

APANTDANNIEGQAIRYQNRFLHLLGKIYYFGNNSKAVTGWQTINGKVYYFMPDTAMAAAGGLFEIDG

VIYFFGVDGVKAPGIYG

Toxin A-derived recombinant antigen - His-[helical spacer]-Thioredoxin-
[thrombin site]-TxA4
                                                                    SEQ ID 37
HHHHHHHHHHHGGSLAEAAAKEAAAKEAAAKEAAAKAAAGGSHMASDKIIHLTDDSFDTDVLK

ADGAILVDFWAEWCGPCKMIAPILDEIADEYQGKLTVAKLNIDQNPGTAPKYGIRGIPTLLLFKNGEVA

ATKVGALSKGQLKEFLDANLARALVPRGSVTSLYKKAGSAAAPFTMIMSDLSSKEYIFFDSIDNKLKAK

SKNIPGLASISEDIKTLLLDASVSPDTKFILNNLKLNIESSIGDYIYYEKLEPVKNIIHNSIDDLIDEFNLLEN

VSDELYELKKLNNLDEKYLISFEDISKNNSTYSVRFINKSNGESVYVETEKEIFSKYSEHITKEISTIKNSII

TDVNGNLLDNIQLDHTSQVNTLNAAFFIQSLIDYSSNKDVLNDLSTSVKVQLYAQLFSTGLNTIYDSIQL

VNLISNAVNDTINVLPTITEGIPIVSTILDGINLGAAIKELLDEHDPLLKKELEAKVGVLAINMSLSIAATVA

SIVGIGAEVTIFLLPIAGISAGIPSLVNNELILHDKATSVVNYFNHLSESKKYGPLKTEDDKILVPIDDLVIS

EIDFNNNSIKLGTCNILAMEGGSGHTVTGNIDHFFSSPSISSHIPSLSIYSAIGIETENLDFSKKIMMLPNA

PSRVFWWETGAVPGLRSLENDGTRLLDSIRDLYPGKFYWRFYAFFDYAITTLKPVYEDTNIKIKLDKDT

RNFIMPTITTNEIRNKLSYSFDGAGGTYSLLLSSYPISTNINLSKDDLWIFNIDNEVREISIENGTIKKGKLI

KDVLSKIDINKNKLIIGNQTIDFSGDIDNKDRYIFLTCELDDKISLIIEINLVAKSYSLLLSGDKNYLISNLSNI

IEKINTLGLDSKNIAYNYTDESNNKYFGAISKTSQKSIIHYKKDSKNILEFYNDSTLEFNSKDFIAEDINVF

MKDDINTITGKYYVDNNTDKSIDFSISLVSKNQVKVNGLYLNESVYSSYLDFVKNSDGHHNTSNFMNL

FLDNISFWKLFGFENINFVIDKYFTLVGKTNLGYVEFICDNNKNIDIYFGEWKTSSSKSTIFSGNGRNVV

VEPIYNPDTGEDISTSLDFSYEPLYGIDRYINKVLIAPDLYTSLININTNYYSNEYYPEIIVLNPNTFHKKV

NINLDSSSFEYKWSTEGSDFILVRYLEESNKKILQKIRIKGILSNTQSFNKMSIDFKDIKKLSLGYIMSNF

KSFNSENELDRDHLGFKIIDNKTYYYDEDSKLVKGLININNSLFYFDPIEFNLVTGWQTINGKKYYFDIN

TGAALISYKIINGKHFYFNNDGVMQLGVFKGPDGFEYFAPANTQNNNIEGQAIVYQSKFLTLNGKKYY

FDNDSKAVTGWRIINNEKYYFNPNNAIAAVGLQVIDNNKYYFNPDTAIISKGWQTVNGSRYYFDTDTAI

AFNGYKTIDGKHFYFDSDCVVKIGVFSTSNGFEYFAPANTYNNNIEGQAIVYQSKFLTLNGKKYYFDN

NSKAVTGWQTIDSKKYYFNTNTAEAATGWQTIDGKKYYFNTNTAEAATGWQTIDGKKYYFNTNTAIA

STGYTIINGKHFYFNTDGIMQIGVFKGPNGFEYFAPANTDANNIEGQAILYQNEFLTLNGKKYYFGSDS

KAVTGWRIINNKKYYFNPNNAIAAIHLCTINNDKYYFSYDGILQNGYITIERNNFYFDANNESKMVTGVF

KGPNGFEYFAPANTHNNNIEGQAIVYQNKFLTLNGKKYYFDNDSKAVTGWQTIDGKKYYFNLNTAEA

ATGWQTIDGKKYYFNLNTAEAATGWQTIDGKKYYFNTNTFIASTGYTSINGKHFYFNTDGIMQIGVFK

GPNGFEYFAPANTHNNNIEGQAILYQNKFLTLNGKKYYFGSDSKAVTGLRTIDGKKYYFNTNTAVAVT
```

-continued

```
GWQTINGKKYYFNTNTSIASTGYTIISGKHFYFNTDGIMQIGVFKGPDGFEYFAPANTDANNIEGQAIR

YQNRFLYLHDNIYYFGNNSKAATGWVTIDGNRYYFEPNTAMGANGYKTIDNKNFYFRNGLPQIGVFK

GSNGFEYFAPANTDANNIEGQAIRYQNRFLHLLGKIYYFGNNSKAVTGWQTINGKVYYFMPDTAMAA

AGGLFEIDGVIYFFGVDGVKAPGIYG
```

Toxin A-derived recombinant antigen - His-Thioredoxin-[linear spacer]-
[thrombin site]-TxA4

SEQ ID 38

```
HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALGGSGGSGGSGGSGG

SGGSGGSGGSGGSLVPRGSGSAAAPFTMIMSDLSSKEYIFFDSIDNKLKAKSKNIPGLASISEDIKTLL

LDASVSPDTKFILNNLKLNIESSIGDYIYYEKLEPVKNIIHNSIDDLIDEFNLLENVSDELYELKKLNNLDE

KYLISFEDISKNNSTYSVRFINKSNGESVYVETEKEIFSKYSEHITKEISTIKNSIITDVNGNLLDNIQLDHT

SQVNTLNAAFFIQSLIDYSSNKDVLNDLSTSVKVQLFSTGLNTIYDSIQLVNLISNAVNDTINVLPTI

TEGIPIVSTILDGINLGAAIKELLDEHDPLLKKELEAKVGVLAINMSLSIAATVASIVGIGAEVTIFLLPIAGIS

AGIPSLVNNELILHDKATSVVNYFNHLSESKKYGPLKTEDDKILVPIDDLVISEIDFNNNSIKLGTCNILAM

EGGSGHTVTGNIDHFFSSPSISSHIPSLSIYSAIGIETENLDFSKKIMMLPNAPSRVFWWETGAVPGLR

SLENDGTRLLDSIRDLYPGKFYWRFYAFFDYAITTLKPVYEDTNIKIKLDKDTRNFIMPTITTNEIRNKLS

YSFDGAGGTYSLLLSSYPISTNINLSKDDLWIFNIDNEVREISIENGTIKKGKLIKDVLSKIDINKNKLIIGN

QTIDFSGDIDNKDRYIFLTCELDDKISLIIEINLVAKSYSLLLSGDKNYLISNLSNIIEKINTLGLDSKNIAYN

YTDESNNKYFGAISKTSQKSIIHYKKDSKNILEFYNDSTLEFNSKDFIAEDINVFMKDDINTITGKYYVDN

NTDKSIDFSISLVSKNQVKVNGLYLNESVYSSYLDFVKNSDGHHNTSNFMNLFLDNISFWKLFGFENIN

FVIDKYFTLVGKTNLGYVEFICDNNKNIDIYFGEWKTSSSKSTIFSGNGRNVVVEPIYNPDTGEDISTSL

DFSYEPLYGIDRYINKVLIAPDLYTSLININTNYYSNEYYPEIIVLNPNTFHKKVNINLDSSSFEYKWSTE

GSDFILVRYLEESNKKILQKIRIKGILSNTQSFNKMSIDFKDIKKLSLGYIMSNFKSFNSENELDRDHLGF

KIIDNKTYYYDEDSKLVKGLININNSLFYFDPIEFNLVTGWQTINGKKYYFDINTGAALISYKIINGKHFYF

NNDGVMQLGVFKGPDGFEYFAPANTQNNNIEGQAIVYQSKFLTLNGKKYYFDNDSKAVTGWRIINNE

KYYFNPNNAIAAVGLQVIDNNKYYFNPDTAIISKGWQTVNGSRYYFDTDTAIAFNGYKTIDGKHFYFDS

DCVVKIGVFSTSNGFEYFAPANTYNNNIEGQAIVYQSKFLTLNGKKYYFDNNSKAVTGWQTIDSKKYY

FNTNTAEAATGWQTIDGKKYYFNTNTAEAATGWQTIDGKKYYFNTNTAIASTGYTIINGKHFYFNTDGI

MQIGVFKGPNGFEYFAPANTDANNIEGQAILYQNEFLTLNGKKYYFGSDSKAVTGWRIINNKKYYFNP

NNAIAAIHLCTINNDKYYFSYDGILQNGYITIERNNFYFDANNESKMVTGVFKGPNGFEYFAPANTHNN

NIEGQAIVYQNKFLTLNGKKYYFDNDSKAVTGWQTIDGKKYYFNLNTAEAATGWQTIDGKKYYFNLNT

AEAATGWQTIDGKKYYFNTNTFIASTGYTSINGKHFYFNTDGIMQIGVFKGPNGFEYFAPANTHNNNIE

GQAILYQNKFLTLNGKKYYFGSDSKAVTGLRTIDGKKYYFNTNTAVAVTGWQTINGKKYYFNTNTSIA

STGYTIISGKHFYFNTDGIMQIGVFKGPDGFEYFAPANTDANNIEGQAIRYQNRFLYLHDNIYYFGNNS

KAATGWVTIDGNRYYFEPNTAMGANGYKTIDNKNFYFRNGLPQIGVFKGSNGFEYFAPANTDANNIE

GQAIRYQNRFLHLLGKIYYFGNNSKAVTGWQTINGKVYYFMPDTAMAAAGGLFEIDGVIYFFGVDGVK

APGIYG
```

Toxin A-derived recombinant antigen - His-Thioredoxin-
[helical spacer]-[thrombin site]-TxA4

SEQ ID 39

```
HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALLAEAAAKEAAAKEAAA
```

-continued

KEAAAKEAAAKAAAGGSLVPRGSGSAAAPFTMIMSDLSSKEYIFFDSIDNKLKAKSKNIPGLASISEDIK
TLLLDASVSPDTKFILNNLKLNIESSIGDYIYYEKLEPVKNIIHNSIDDLIDEFNLLENVSDELYELKKLNNL
DEKYLISFEDISKNNSTYSVRFINKSNGESVYVETEKEIFSKYSEHITKEISTIKNSIITDVNGNLLDNIQLD
HTSQVNTLNAAFFIQSLIDYSSNKDVLNDLSTSVKVQLYAQLFSTGLNTIYDSIQLVNLISNAVNDTINVL
PTITEGIPIVSTILDGINLGAAIKELLDEHDPLLKKELEAKVGVLAINMSLSIAATVASIVGIGAEVTIFLLPIA
GISAGIPSLVNNELILHDKATSVVNYFNHLSESKKYGPLKTEDDKILVPIDDLVISEIDFNNNSIKLGTCNI
LAMEGGSGHTVTGNIDHFFSSPSISSHIPSLSIYSAIGIETENLDFSKKIMMLPNAPSRVFWWETGAVP
GLRSLENDGTRLLDSIRDLYPGKFYWRFYAFFDYAITTLKPVYEDTNIKIKLDKDTRNFIMPTITTNEIRN
KLSYSFDGAGGTYSLLLSSYPISTNINLSKDDLWIFNIDNEVREISIENGTIKKGKLIKDVLSKIDINKNKLII
GNQTIDFSGDIDNKDRYIFLTCELDDKISLIIEINLVAKSYSLLLSGDKNYLISNLSNIIEKINTLGLDSKNIA
YNYTDESNNKYFGAISKTSQKSIIHYKKDSKNILEFYNDSTLEFNSKDFIAEDINVFMKDDINTITGKYYV
DNNTDKSIDFSISLVSKNQVKVNGLYLNESVYSSYLDFVKNSDGHHNTSNFMNLFLDNISFWKLFGFE
NINFVIDKYFTLVGKTNLGYVEFICDNNKNIDIYFGEWKTSSSKSTIFSGNGRNVVVEPIYNPDTGEDIS
TSLDFSYEPLYGIDRYINKVLIAPDLYTSLININTNYYSNEYYPEIIVLNPNTFHKKVNINLDSSSFEYKWS
TEGSDFILVRYLEESNKKILQKIRIKGILSNTQSFNKMSIDFKDIKKLSLGYIMSNFKSFNSENELDRDHL
GFKIIDNKTYYYDEDSKLVKGLININNSLFYFDPIEFNLVTGWQTINGKKYYFDINTGAALISYKIINGKHF
YFNNDGVMQLGVFKGPDGFEYFAPANTQNNNIEGQAIVYQSKFLTLNGKKYYFDNDSKAVTGWRIIN
NEKYYFNPNNAIAAVGLQVIDNNKYYFNPDTAIISKGWQTVNGSRYYFDTDTAIAFNGYKTIDGKHFYF
DSDCVVKIGVFSTSNGFEYFAPANTYNNNIEGQAIVYQSKFLTLNGKKYYFDNNSKAVTGWQTIDSKK
YYFNTNTAEAATGWQTIDGKKYYFNTNTAEAATGWQTIDGKKYYFNTNTAIASTGYTIINGKHFYFNT
DGIMQIGVFKGPNGFEYFAPANTDANNIEGQAILYQNEFLTLNGKKYYFGSDSKAVTGWRIINNKKYY
FNPNNAIAAIHLCTINNDKYYFSYDGILQNGYITIERNNFYFDANNESKMVTGVFKGPNGFEYFAPANT
HNNNIEGQAIVYQNKFLTLNGKKYYFDNDSKAVTGWQTIDGKKYYFNLTAEAATGWQTIDGKKYYF
NLNTAEAATGWQTIDGKKYYFNTNTFIASTGYTSINGKHFYFNTDGIMQIGVFKGPNGFEYFAPANTH
NNNNIEGQAILYQNKFLTLNGKKYYFGSDSKAVTGLRTIDGKKYYFNTNTAVAVTGWQTINGKKYYFNT
NTSIASTGYTIISGKHFYFNTDGIMQIGVFKGPDGFEYFAPANTDANNIEGQAIRYQNRFLYLHDNIYYF
GNNSKAATGWVTIDGNRYYFEPNTAMGANGYKTIDNKNFYFRNGLPQIGVFKGSNGFEYFAPANTD
ANNIEGQAIRYQNRFLHLLGKIYYFGNNSKAVTGWQTINGKVYYFMPDTAMAAAGGLFEIDGVIYFFG
VDGVKAPGIYG

Toxin A-derived recombinant antigen - His-[linear spacer]-
Thioredoxin- [thrombin site]-TxA3

SEQ ID 40

HHHHHHHHHHGGSGGSGGSGGSGGSGGSGGSGGSGGSHMASDKIIHLTDDSFDTDVLKADGA
ILVDFWAEWCGPCKMIAPILDEIADEYQGKLTVAKLNIDQNPGTAPKYGIRGIPTLLLFKNGEVAATKVG
ALSKGQLKEFLDANLARALVPRGSVTSLYKKAGSAAAPFTMESKKYGPLKTEDDKILVPIDDLVISEIDF
NNNSIKLGTCNILAMEGGSGHTVTGNIDHFFSSPSISSHIPSLSIYSAIGIETENLDFSKKIMMLPNAPSR
VFWWETGAVPGLRSLENDGTRLLDSIRDLYPGKFYWRFYAFFDYAITTLKPVYEDTNIKIKLDKDTRNF
IMPTITTNEIRNKLSYSFDGAGGTYSLLLSSYPISTNINLSKDDLWIFNIDNEVREISIENGTIKKGKLIKDV
LSKIDINKNKLIIGNQTIDFSGDIDNKDRYIFLTCELDDKISLIIEINLVAKSYSLLLSGDKNYLISNLSNIIEKI
NTLGLDSKNIAYNYTDESNNKYFGAISKTSQKSIIHYKKDSKNILEFYNDSTLEFNSKDFIAEDINVFMKD
DINTITGKYYVDNNTDKSIDFSISLVSKNQVKVNGLYLNESVYSSYLDFVKNSDGHHNTSNFMNLFLDN
ISFWKLFGFENINFVIDKYFTLVGKTNLGYVEFICDNNKNIDIYFGEWKTSSSKSTIFSGNGRNVVVEPI

-continued

YNPDTGEDISTSLDFSYEPLYGIDRYINKVLIAPDLYTSLININTNYYSNEYYPEIIVLNPNTFHKKVNINL

DSSSFEYKWSTEGSDFILVRYLEESNKKILQKIRIKGILSNTQSFNKMSIDFKDIKKLSLGYIMSNFKSFN

SENELDRDHLGFKIIDNKTYYYDEDSKLVKGLININNSLFYFDPIEFNLVTGWQTINGKKYYFDINTGAA

LISYKIINGKHFYFNNDGVMQLGVFKGPDGFEYFAPANTQNNNIEGQAIVYQSKFLTLNGKKYYFDND

SKAVTGWRIINNEKYYFNPNNAIAAVGLQVIDNNKYYFNPDTAIISKGWQTVNGSRYYFDTDTAIAFNG

YKTIDGKHFYFDSDCVVKIGVFSTSNGFEYFAPANTYNNNIEGQAIVYQSKFLTLNGKKYYFDNNSKA

VTGWQTIDSKKYYFNTNTAEAATGWQTIDGKKYYFNTNTAEAATGWQTIDGKKYYFNTNTAIASTGY

TIINGKHFYFNTDGIMQIGVFKGPNGFEYFAPANTDANNIEGQAILYQNEFLTLNGKKYYFGSDSKAVT

GWRIINNKKYYFNPNNAIAAIHLCTINNDKYYFSYDGILQNGYITIERNNFYFDANNESKMVTGVFKGPN

GFEYFAPANTHNNNIEGQAIVYQNKFLTLNGKKYYFDNDSKAVTGWQTIDGKKYYFNLNTAEAATGW

QTIDGKKYYFNLNTAEAATGWQTIDGKKYYFNTNTFIASTGYTSINGKHFYFNTDGIMQIGVFKGPNGF

EYFAPANTHNNNIEGQAILYQNKFLTLNGKKYYFGSDSKAVTGLRTIDGKKYYFNTNTAVAVTGWQTI

NGKKYYFNTNTSIASTGYTIISGKHFYFNTDGIMQIGVFKGPDGFEYFAPANTDANNIEGQAIRYQNRF

LYLHDNIYYFGNNSKAATGWVTIDGNRYYFEPNTAMGANGYKTIDNKNFYFRNGLPQIGVFKGSNGF

EYFAPANTDANNIEGQAIRYQNRFLHLLGKIYYFGNNSKAVTGWQTINGKVYYFMPDTAMAAAGGLF

EIDGVIYFFGVDGVKAPGIYG

Toxin A-derived recombinant antigen - His-[helical spacer]-
Thioredoxin- [thrombin site]-TxA3

SEQ ID 41

HHHHHHHHHHGGSLAEAAAKEAAAKEAAAKEAAAKEAAAKAAAGGSHMASDKIIHLTDDSFDTDVLK

ADGAILVDFWAEWCGPCKMIAPILDEIADEYQGKLTVAKLNIDQNPGTAPKYGIRGIPTLLLFKNGEVA

ATKVGALSKGQLKEFLDANLARALVPRGSVTSLYKKAGSAAAPFTMESKKYGPLKTEDDKILVPIDDL

VISEIDFNNNSIKLGTCNILAMEGGSGHTVTGNIDHFFSSPSISSHIPSLSIYSAIGIETENLDFSKKIMML

PNAPSRVFWWETGAVPGLRSLENDGTRLLDSIRDLYPGKFYWRFYAFFDYAITTLKPVYEDTNIKIKL

DKDTRNFIMPTITTNEIRNKLSYSFDGAGGTYSLLLSSYPISTNINLSKDDLWIFNIDNEVREISIENGTIK

KGKLIKDVLSKIDINKNKLIIGNQTIDFSGDIDNKDRYIFLTCELDDKISLIIEINLVAKSYSLLLSGDKNYLIS

NLSNIIEKINTLGLDSKNIAYNYTDESNNKYFGAISKTSQKSIIHYKKDSKNILEFYNDSTLEFNSKDFIAE

DINVFMKDDINTITGKYYVDNNTDKSIDFSISLVSKNQVKVNGLYLNESVYSSYLDFVKNSDGHHNTSN

FMNLFLDNISFWKLFGFENINFVIDKYFTLVGKTNLGYVEFICDNNKNIDIYFGEWKTSSSKSTIFSGNG

RNVVVEPIYNPDTGEDISTSLDFSYEPLYGIDRYINKVLIAPDLYTSLININTNYYSNEYYPEIIVLNPNTF

HKKVNINLDSSSFEYKWSTEGSDFILVRYLEESNKKILQKIRIKGILSNTQSFNKMSIDFKDIKKLSLGYI

MSNFKSFNSENELDRDHLGFKIIDNKTYYYDEDSKLVKGLININNSLFYFDPIEFNLVTGWQTINGKKYY

FDINTGAALISYKIINGKHFYFNNDGVMQLGVFKGPDGFEYFAPANTQNNNIEGQAIVYQSKFLTLNGK

KYYFDNDSKAVTGWRIINNEKYYFNPNNAIAAVGLQVIDNNKYYFNPDTAIISKGWQTVNGSRYYFDT

DTAIAFNGYKTIDGKHFYFDSDCVVKIGVFSTSNGFEYFAPANTYNNNIEGQAIVYQSKFLTLNGKKYY

FDNNSKAVTGWQTIDSKKYYFNTNTAEAATGWQTIDGKKYYFNTNTAEAATGWQTIDGKKYYFNTNT

AIASTGYTIINGKHFYFNTDGIMQIGVFKGPNGFEYFAPANTDANNIEGQAILYQNEFLTLNGKKYYFGS

DSKAVTGWRIINNKKYYFNPNNAIAAIHLCTINNDKYYFSYDGILQNGYITIERNNFYFDANNESKMVTG

VFKGPNGFEYFAPANTHNNNIEGQAIVYQNKFLTLNGKKYYFDNDSKAVTGWQTIDGKKYYFNLNTA

EAATGWQTIDGKKYYFNLNTAEAATGWQTIDGKKYYFNTNTFIASTGYTSINGKHFYFNTDGIMQIGV

FKGPNGFEYFAPANTHNNNIEGQAILYQNKFLTLNGKKYYFGSDSKAVTGLRTIDGKKYYFNTNTAVA

VTGWQTINGKKYYFNTNTSIASTGYTIISGKHFYFNTDGIMQIGVFKGPDGFEYFAPANTDANNIEGQA

IRYQNRFLYLHDNIYYFGNNSKAATGWVTIDGNRYYFEPNTAMGANGYKTIDNKNFYFRNGLPQIGVF

KGSNGFEYFAPANTDANNIEGQAIRYQNRFLHLLGKIYYFGNNSKAVTGWQTINGKVYYFMPDTAMA

AAGGLFEIDGVIYFFGVDGVKAPGIYG

Toxin A-derived recombinant antigen - His-Thioredoxin-
[linear spacer]-[thrombin site]-TxA3
SEQ ID 42

HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALGGSGGSGGSGGSGG

SGGSGGSGGSGGSLVPRGSGSAAAPFTMESKKYGPLKTEDDKILVPIDDLVISEIDFNNNSIKLGTCNI

LAMEGGSGHTVTGNIDHFFSSPSISSHIPSLSIYSAIGIETENLDFSKKIMMLPNAPSRVFWWETGAVP

GLRSLENDGTRLLDSIRDLYPGKFYWRFYAFFDYAITTLKPVYEDTNIKIKLDKDTRNFIMPTITTNEIRN

KLSYSFDGAGGTYSLLLSSYPISTNINLSKDDLWIFNIDNEVREISIENGTIKKGKLIKDVLSKIDINKNKLII

GNQTIDFSGDIDNKDRYIFLTCELDDKISLIIEINLVAKSYSLLLSGDKNYLISNLSNIIEKINTLGLDSKNIA

YNYTDESNNKYFGAISKTSQKSIIHYKKDSKNILEFYNDSTLEFNSKDFIAEDINVFMKDDINTITGKYYV

DNNTDKSIDFSISLVSKNQVKVNGLYLNESVYSSYLDFVKNSDGHHNTSNFMNLFLDNISFWKLFGFE

NINFVIDKYFTLVGKTNLGYVEFICDNNKNIDIYFGEWKTSSSKSTIFSGNGRNVVVEPIYNPDTGEDIS

TSLDFSYEPLYGIDRYINKVLIAPDLYTSLININTNYYSNEYYPEIIVLNPNTFHKKVNINLDSSSFEYKWS

TEGSDFILVRYLEESNKKILQKIRIKGILSNTQSFNKMSIDFKDIKKLSLGYIMSNFKSFNSENELDRDHL

GFKIIDNKTYYYDEDSKLVKGLININNSLFYFDPIEFNLVTGWQTINGKKYYFDINTGAALISYKIINGKHF

YFNNDGVMQLGVFKGPDGFEYFAPANTQNNNIEGQAIVYQSKFLTLNGKKYYFDNDSKAVTGWRIIN

NEKYYFNPNNAIAAVGLQVIDNNKYYFNPDTAIISKGWQTVNGSRYYFDTDTAIAFNGYKTIDGKHFYF

DSDCVVKIGVFSTSNGFEYFAPANTYNNNIEGQAIVYQSKFLTLNGKKYYFDNNSKAVTGWQTIDSKK

YYFNTNTAEAATGWQTIDGKKYYFNTNTAEAATGWQTIDGKKYYFNTNTAIASTGYTIINGKHFYFNT

DGIMQIGVFKGPNGFEYFAPANTDANNIEGQAILYQNEFLTLNGKKYYFGSDSKAVTGWRIINNKKYY

FNPNNAIAAIHLCTINNDKYYFSYDGILQNGYITIERNNFYFDANNESKMVTGVFKGPNGFEYFAPANT

HNNNIEGQAIVYQNKFLTLNGKKYYFDNDSKAVTGWQTIDGKKYYFNLNTAEAATGWQTIDGKKYYF

NLNTAEAATGWQTIDGKKYYFNTNTFIASTGYTSINGKHFYFNTDGIMQIGVFKGPNGFEYFAPANTH

NNNIEGQAILYQNKFLTLNGKKYYFGSDSKAVTGLRTIDGKKYYFNTNTAVAVTGWQTINGKKYYFNT

NTSIASTGYTIISGKHFYFNTDGIMQIGVFKGPDGFEYFAPANTDANNIEGQAIRYQNRFLYLHDNIYYF

GNNSKAATGWVTIDGNRYYFEPNTAMGANGYKTIDNKNFYFRNGLPQIGVFKGSNGFEYFAPANTD

ANNIEGQAIRYQNRFLHLLGKIYYFGNNSKAVTGWQTINGKVYYFMPDTAMAAAGGLFEIDGVIYFFG

VDGVKAPGIYG

Toxin A-derived recombinant antigen - His-Thioredoxin-
[helical spacer]-[thrombin site]-TxA3
SEQ ID 43

HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALLAEAAAKEAAAKEAAA

KEAAAKEAAAKAAAGGSLVPRGSGSAAAPFTMESKKYGPLKTEDDKILVPIDDLVISEIDFNNNSIKLG

TCNILAMEGGSGHTVTGNIDHFFSSPSISSHIPSLSIYSAIGIETENLDFSKKIMMLPNAPSRVFWWETG

AVPGLRSLENDGTRLLDSIRDLYPGKFYWRFYAFFDYAITTLKPVYEDTNIKIKLDKDTRNFIMPTITTN

EIRNKLSYSFDGAGGTYSLLLSSYPISTNINLSKDDLWIFNIDNEVREISIENGTIKKGKLIKDVLSKIDINK

NKLIIGNQTIDFSGDIDNKDRYIFLTCELDDKISLIIEINLVAKSYSLLLSGDKNYLISNLSNIIEKINTLGLDS

KNIAYNYTDESNNKYFGAISKTSQKSIIHYKKDSKNILEFYNDSTLEFNSKDFIAEDINVFMKDDINTITG

KYYVDNNTDKSIDFSISLVSKNQVKVNGLYLNESVYSSYLDFVKNSDGHHNTSNFMNLFLDNISFWKL

-continued

FGFENINFVIDKYFTLVGKTNLGYVEFICDNNKNIDIYFGEWKTSSSKSTIFSGNGRNVVVEPIYNPDTG

EDISTSLDFSYEPLYGIDRYINKVLIAPDLYTSLININTNYYSNEYYPEIIVLNPNTFHKKVNINLDSSSFEY

KWSTEGSDFILVRYLEESNKKILQKIRIKGILSNTQSFNKMSIDFKDIKKLSLGYIMSNFKSFNSENELDR

DHLGFKIIDNKTYYYDEDSKLVKGLININNSLFYFDPIEFNLVTGWQTINGKKYYFDINTGAALISYKIING

KHFYFNNDGVMQLGVFKGPDGFEYFAPANTQNNNIEGQAIVYQSKFLTLNGKKYYFDNDSKAVTGW

RIINNEKYYFNPNNAIAAVGLQVIDNNKYYFNPDTAIISKGWQTVNGSRYYFDTDTAIAFNGYKTIDGKH

FYFDSDCVVKIGVFSTSNGFEYFAPANTYNNNIEGQAIVYQSKFLTLNGKKYYFDNNSKAVTGWQTID

SKKYYFNTNTAEAATGWQTIDGKKYYFNTNTAEAATGWQTIDGKKYYFNTNTAIASTGYTIINGKHFYF

NTDGIMQIGVFKGPNGFEYFAPANTDANNIEGQAILYQNEFLTLNGKKYYFGSDSKAVTGWRIINNKK

YYFNPNNAIAAIHLCTINNDKYYFSYDGILQNGYITIERNNFYFDANNESKMVTGVFKGPNGFEYFAPA

NTHNNNIEGQAIVYQNKFLTLNGKKYYFDNDSKAVTGWQTIDGKKYYFNLNTAEAATGWQTIDGKKY

YFNLNTAEAATGWQTIDGKKYYFNTNTFIASTGYTSINGKHFYFNTDGIMQIGVFKGPNGFEYFAPAN

THNNNIEGQAILYQNKFLTLNGKKYYFGSDSKAVTGLRTIDGKKYYFNTNTAVAVTGWQTINGKKYYF

NTNTSIASTGYTIISGKHFYFNTDGIMQIGVFKGPDGFEYFAPANTDANNIEGQAIRYQNRFLYLHDNIY

YFGNNSKAATGWVTIDGNRYYFEPNTAMGANGYKTIDNKNFYFRNGLPQIGVFKGSNGFEYFAPANT

DANNIEGQAIRYQNRFLHLLGKIYYFGNNSKAVTGWQTINGKVYYFMPDTAMAAAGGLFEIDGVIYFF

GVDGVKAPGIYG

Toxin B-derived recombinant antigen - His-[linear spacer]-
NusA-[thrombin site]-TxB4

SEQ ID 44

HHHHHHHHHGGSGGSGGSGGSGGSGGSGGSGGSGGSGGSGGSHMASNKEILAVVEAVSNEKALPRE

KIFEALESALATATKKKYEQEIDVRVQIDRKSGDFDTFRRWLVVDEVTQPTKEITLEAARYEDESLNLG

DYVEDQIESVTFDRITTQTAKQVIVQKVREAERAMVVDQFREHEGEIITGVVKKVNRDNISLDLGNNAE

AVILREDMLPRENFRPGDRVRGVLYSVRPEARGAQLFVTRSKPEMLIELFRIEVPEIGEEVIEIKAAARD

PGSRAKIAVKTNDKRIDPVGACVGMRGARVQAVSTELGGERIDIVLWDDNPAQFVINAMAPADVASIV

VDEDKHTMDIAVEAGNLAQAIGRNGQNVRLASQLSGWELNVMTVDDLQAKHQAEAHAAIDTFTKYLD

IDEDFATVLVEEGFSTLEELAYVPMKELLEIEGLDEPTVEALRERAKNALATIAQAQEESLGDNKPADD

LLNLEGVDRDLAFKLAARGVCTLEDLAEQGIDDLADIEGLTDEKAGALIMAARNICWFGDEASGALVP

RGSVTSLYKKAGSAAAPFTMSIIKDISSKEYISFNPKENKITVKSKNLPELSTLLQEIRNNSNSSDIELEE

KVMLTECEINVISNIDTQIVEERIEEAKNLTSDSINYIKDEFKLIESISDALCDLKQQNELEDSHFISFEDIS

ETDEGFSIRFINKETGESIFVETEKTIFSEYANHITEEISKIKGTIFDTVNGKLVKKVNLDTTHEVNTLNAA

FFIQSLIEYNSSKESLSNLSVAMKVQVYAQLFSTGLNTITDAAKVVELVSTALDETIDLLPTLSEGLPIIAT

IIDGVSLGAAIKELSETSDPLLRQEIEAKIGIMAVNLTTATTAIITSSLGIASGFSILLVPLAGISAGIPSLVN

NELVLRDKATKVVDYFKHVSLVETEGVFTLLDDKIMMPQDDLVISEIDFNNNSIVLGKCEIWRMEGGS

GHTVTDDIDHFFSAPSITYREPHLSIYDVLEVQKEELDLSKDLMVLPNAPNRVFAWETGWTPGLRSLE

NDGTKLLDRIRDNYEGEFYWRYFAFIADALITTLKPRYEDTNIRINLDSNTRSFIVPIITTEYIREKLSYSF

YGSGGTYALSLSQYNMGINIELSESDVWIIDVDNVVRDVTIESDKIKKGDLIEGILSTLSIEENKIILNSHEI

NFSGEVNGSNGFVSLTFSILEGINAIIEVDLLSKSYKLLISGELKILMLNSNHIQQKIDYIGFNSELQKNIP

YSFVDSEGKENGFINGSTKEGLFVSELPDVVLISKVYMDDSKPSFGYYSNNLKDVKVITKDNVNILTGY

YLKDDIKISLSLTLQDEKTIKLNSVHLDESGVAEILKFMNRKGNTNTSDSLMSFLESMNIKSIFVNFLQS

NIKFILDANFIISGTTSIGQFEFICDENDNIQPYFIKFNTLETNYTLYVGNRQNMIVEPNYDLDDSGDISST

VINFSQKYLYGIDSCVNKVVISPNIYTDEINITPVYETNNTYPEVIVLDANYINEKINVNINDLSIRYVWSN

-continued

DGNDFILMSTSEENKVSQVKIRFVNVFKDKTLANKLSFNFSDKQDVPVSEIILSFTPSYYEDGLIGYDLG
LVSLYNEKFYINNFGMMVSGLIYINDSLYYFKPPVNNLITGFVTVGDDKYYFNPINGGAASIGETIIDDKN
YYFNQSGVLQTGVFSTEDGFKYFAPANTLDENLEGEAIDFTGKLIIDENIYYFDDNYRGAVEWKELDG
EMHYFSPETGKAFKGLNQIGDYKYYFNSDGVMQKGFVSINDNKHYFDDSGVMKVGYTEIDGKHFYF
AENGEMQIGVFNTEDGFKYFAHHNEDLGNEEGEEISYSGILNFNNKIYYFDDSFTAVVGWKDLEDGS
KYYFDEDTAEAYIGLSLINDGQYYFNDDGIMQVGFVTINDKVFYFSDSGIIESGVQNIDDNYFYIDDNGI
VQIGVFDTSDGYKYFAPANTVNDNIYGQAVEYSGLVRVGEDVYYFGETYTIETGWIYDMENESDKYY
FNPETKKACKGINLIDDIKYYFDEKGIMRTGLISFENNNYYFNENGEMQFGYINIEDKMFYFGEDGVMQ
IGVFNTPDGFKYFAHQNTLDENFEGESINYTGWLDLDEKRYYFTDEYIAATGSVIIDGEEYYFDPDTAQ
LVISE.

Toxin B-derived recombinant antigen - His-NusA-[linear spacer]-[thrombin site]-TxB4

SEQ ID 45

HHHHHHSHMASNKEILAVVEAVSNEKALPREKIFEALESALATATKKKYEQEIDVRVQIDRKSGDFDTF
RRWLVVDEVTQPTKEITLEAARYEDESLNLGDYVEDQIESVTFDRITTQTAKQVIVQKVREAERAMVV
DQFREHEGEIITGVVKKVNRDNISLDLGNNAEAVILREDMLPRENFRPGDRVRGVLYSVRPEARGAQL
FVTRSKPEMLIELFRIEVPEIGEEVIEIKAAARDPGSRAKIAVKTNDKRIDPVGACVGMRGARVQAVSTE
LGGERIDIVLWDDNPAQFVINAMAPADVASIVVDEDKHTMDIAVEAGNLAQAIGRNGQNVRLASQLSG
WELNVMTVDDLQAKHQAEAHAAIDTFTKYLDIDEDFATVLVEEGFSTLEELAYVPMKELLEIEGLDEPT
VEALRERAKNALATIAQAQEESLGDNKPADDLLNLEGVDRDLAFKLAARGVCTLEDLAEQGIDDLADI
EGLTDEKAGALIMAARNICWFGDEASGALGGSGGSGGSGGSGGSGGSGGSGGSLVPRGSGS
AAAPFTMSIIKDISSKEYISFNPKENKITVKSKNLPELSTLLQEIRNNSNSSDIELEEKVMLTECEINVISNI
DTQIVEERIEEAKNLTSDSINYIKDEFKLIESISDALCDLKQQNELEDSHFISFEDISETDEGFSIRFINKET
GESIFVETEKTIFSEYANHITEEISKIKGTIFDTVNGKLVKKVNLDTTHEVNTLNAAFFIQSLIEYNSSKES
LSNLSVAMKVQVYAQLFSTGLNTITDAAKVVELVSTALDETIDLLPTLSEGLPIIATIIDGVSLGAAIKELS
ETSDPLLRQEIEAKIGIMAVNLTTATTAIITSSLGIASGFSILLVPLAGISAGIPSLVNNELVLRDKATKVVD
YFKHVSLVETEGVFTLLDDKIMMPQDDLVISEIDFNNNSIVLGKCEIWRMEGGSGHTVTDDIDHFFSAP
SITYREPHLSIYDVLEVQKEELDLSKDLMVLPNAPNRVFAWETGWTPGLRSLENDGTKLLDRIRDNYE
GEFYWRYFAFIADALITTLKPRYEDTNIRINLDSNTRSFIVPIITTEYIREKLSYSFYGSGGTYALSLSQYN
MGINIELSESDVWIIDVDNVVRDVTIESDKIKKGDLIEGILSTLSIEENKIILNSHEINFSGEVNGSNGFVSL
TFSILEGINAIIEVDLLSKSYKLLISGELKILMLNSNHIQQKIDYIGFNSELQKNIPYSFVDSEGKENGFING
STKEGLFVSELPDVVLISKVYMDDSKPSFGYYSNNLKDVKVITKDNVNILTGYYLKDDIKISLSLTLQDE
KTIKLNSVHLDESGVAEILKFMNRKGNTNTSDSLMSFLESMNIKSIFVNFLQSNIKFILDANFIISGTTSIG
QFEFICDENDNIQPYFIKFNTLETNYTLYVGNRQNMIVEPNYDLDDSGDISSTVINFSQKYLYGIDSCVN
KVVISPNIYTDEINITPVYETNNTYPEVIVLDANYINEKINVNINDLSIRYVWSNDGNDFILMSTSEENKVS
QVKIRFVNVFKDKTLANKLSFNFSDKQDVPVSEIILSFTPSYYEDGLIGYDLGLVSLYNEKFYINNFGMM
VSGLIYINDSLYYFKPPVNNLITGFVTVGDDKYYFNPINGGAASIGETIIDDKNYYFNQSGVLQTGVFST
EDGFKYFAPANTLDENLEGAIDFTGKLIIDENIYYFDDNYRGAVEWKELDGEMHYFSPETGKAFKGL
NQIGDYKYYFNSDGVMQKGFVSINDNKHYFDDSGVMKVGYTEIDGKHFYFAENGEMQIGVFNTEDG
FKYFAHHNEDLGNEEGEEISYSGILNFNNKIYYFDDSFTAVVGWKDLEDGSKYYFDEDTAEAYIGLSLI
NDGQYYFNDDGIMQVGFVTINDKVFYFSDSGIIESGVQNIDDNYFYIDDNGIVQIGVFDTSDGYKYFAP
ANTVNDNIYGQAVEYSGLVRVGEDVYYFGETYTIETGWIYDMENESDKYYFNPETKKACKGINLIDDIK

-continued

YYFDEKGIMRTGLISFENNNYYFNENGEMQFGYINIEDKMFYFGEDGVMQIGVFNTPDGFKYFAHQN

TLDENFEGESINYTGWLDLDEKRYYFTDEYIAATGSVIIDGEEYYFDPDTAQLVISE.

Toxin B-derived recombinant antigen - His-[helical spacer]-[thrombin site]-NusA-B4
SEQ ID 46

HHHHHHHHHHGGSLAEAAAKEAAAKEAAAKEAAAKEAAAKAAAGGSHMASNKEILAVVEAVSNEKA

LPREKIFEALESALATATKKKYEQEIDVRVQIDRKSGDFDTFRRWLVVDEVTQPTKEITLEAARYEDES

LNLGDYVEDQIESVTFDRITTQTAKQVIVQKVREAERAMVVDQFREHEGEIITGVVKKVNRDNISLDLG

NNAEAVILREDMLPRENFRPGDRVRGVLYSVRPEARGAQLFVTRSKPEMLIELFRIEVPEIGEEVIEIKA

AARDPGSRAKIAVKTNDKRIDPVGACVGMRGARVQAVSTELGGERIDIVLWDDNPAQFVINAMAPAD

VASIVVDEDKHTMDIAVEAGNLAQAIGRNGQNVRLASQLSGWELNVMTVDDLQAKHQAEAHAAIDTF

TKYLDIDEDFATVLVEEGFSTLEELAYVPMKELLEIEGLDEPTVEALRERAKNALATIAQAQEESLGDN

KPADDLLNLEGVDRDLAFKLAARGVCTLEDLAEQGIDDLADIEGLTDEKAGALIMAARNICWFGDEAS

GALVPRGSVTSLYKKAGSAAAPFTMSIIKDISSKEYISFNPKENKITVKSKNLPELSTLLQEIRNNSNSS

DIELEEKVMLTECEINVISNIDTQIVEERIEEAKNLTSDSINYIKDEFKLIESISDALCDLKQQNELEDSHFI

SFEDISETDEGFSIRFINKETGESIFVETEKTIFSEYANHITEEISKIKGTIFDTVNGKLVKKVNLDTTHEV

NTLNAAFFIQSLIEYNSSKESLSNLSVAMKVQVYAQLFSTGLNTITDAAKVVELVSTALDETIDLLPTLSE

GLPIIATIIDGVSLGAAIKELSETSDPLLRQEIEAKIGIMAVNLTTATTAIITSSLGIASGFSILLVPLAGISAGI

PSLVNNELVLRDKATKVVDYFKHVSLVETEGVFTLLLDDKIMMPQDDLVISEIDFNNNSIVLGKCEIWRM

EGGSGHTVTDDIDHFFSAPSITYREPHLSIYDVLEVQKEELDLSKDLMVLPNAPNRVFAWETGWTPGL

RSLENDGTKLLDRIRDNYEGEFYWRYFAFIADALITTLKPRYEDTNIRINLDSNTRSFIVPIITTEYIREKL

SYSFYGSGGTYALSLSQYNMGINIELSESDVWIIDVDNVVRDVTIESDKIKKGDLIEGILSTLSIEENKIIL

NSHEINFSGEVNGSNGFVSLTFSILEGINAIIEVDLLSKSYKLLISGELKILMLNSNHIQQKIDYIGFNSEL

QKNIPYSFVDSEGKENGFINGSTKEGLFVSELPDVVLISKVYMDDSKPSFGYYSNNLKDVKVITKDNV

NILTGYYLKDDIKISLSLTLQDEKTIKLNSVHLDESGVAEILKFMNRKGNTNTSDSLMSFLESMNIKSIFV

NFLQSNIKFILDANFIISGTTSIGQFEFICDENDNIQPYFIKFNTLETNYTLYVGNRQNMIVEPNYDLDDS

GDISSTVINFSQKYLYGIDSCVNKVVISPNIYTDEINITPVYETNNTYPEVIVLDANYINEKINVNINDLSIR

YVWSNDGNDFILMSTSEENKVSQVKIRFVNVFKDKTLANKLSFNFSDKQDVPVSEIILSFTPSYYEDGL

IGYDLGLVSLYNEKFYINNFGMMVSGLIYINDSLYYFKPPVNNLITGFVTVGDDKYYFNPINGGAASIGE

TIIDDKNYYFNQSGVLQTGVFSTEDGFKYFAPANTLDENLEGEAIDFTGKLIIDENIYYFDDNYRGAVE

WKELDGEMHYFSPETGKAFKGLNQIGDYKYYFNSDGVMQKGFVSINDNKHYFDDSGVMKVGYTEID

GKHFYFAENGEMQIGVFNTEDGFKYFAHHNEDLGNEEGEEISYSGILNFNNKIYYFDDSFTAVVGWK

DLEDGSKYYFDEDTAEAYIGLSLINDGQYYFNDDGIMQVGFVTINDKVFYFSDSGIIESGVQNIDDNYF

YIDDNGIVQIGVFDTSDGYKYFAPANTVNDNIYGQAVEYSGLRVGEDVYYFGETYTIETGWIYDMEN

ESDKYYFNPETKKACKGINLIDDIKYYFDEKGIMRTGLISFENNNYYFNENGEMQFGYINIEDKMFYFG

EDGVMQIGVFNTPDGFKYFAHQNTLDENFEGESINYTGWLDLDEKRYYFTDEYIAATGSVIIDGEEYY

FDPDTAQLVISE

Toxin B-derived recombinant antigen - His-NusA-[helical spacer]-[thrombin site]-TxB4
SEQ ID 47

HHHHHHSHMASNKEILAVVEAVSNEKALPREKIFEALESALATATKKKYEQEIDVRVQIDRKSGDFDTF

RRWLVVDEVTQPTKEITLEAARYEDESLNLGDYVEDQIESVTFDRITTQTAKQVIVQKVREAERAMVV

DQFREHEGEIITGVVKKVNRDNISLDLGNNAEAVILREDMLPRENFRPGDRVRGVLYSVRPEARGAQL

FVTRSKPEMLIELFRIEVPEIGEEVIEIKAAARDPGSRAKIAVKTNDKRIDPVGACVGMRGARVQAVSTE

LGGERIDIVLWDDNPAQFVINAMAPADVASIVVDEDKHTMDIAVEAGNLAQAIGRNGQNVRLASQLSG

```
WELNVMTVDDLQAKHQAEAHAAIDTFTKYLDIDEDFATVLVEEGFSTLEELAYVPMKELLEIEGLDEPT

VEALRERAKNALATIAQAQEESLGDNKPADDLLNLEGVDRDLAFKLAARGVCTLEDLAEQGIDDLADI

EGLTDEKAGALIMAARNICWFGDEASGALLAEAAAKEAAAKEAAAKEAAAKEAAAKAAAGGSLVPRG

SGSAAAPFTMSIIKDISSKEYISFNPKENKITVKSKNLPELSTLLQEIRNNSNSSDIELEEKVMLTECEINV

ISNIDTQIVEERIEEAKNLTSDSINYIKDEFKLIESISDALCDLKQQNELEDSHFISFEDISETDEGFSIRFIN

KETGESIFVETEKTIFSEYANHITEEISKIKGTIFDTVNGKLVKKVNLDTTHEVNTLNAAFFIQSLIEYNSS

KESLSNLSVAMKVQVYAQLFSTGLNTITDAAKVVELVSTALDETIDLLPTLSEGLPIIATIIDGVSLGAAIK

ELSETSDPLLRQEIEAKIGIMAVNLTTATTAIITSSLGIASGFSILLVPLAGISAGIPSLVNNELVLRDKATK

VVDYFKHVSLVETEGVFTLLDDKIMMPQDDLVISEIDFNNNSIVLGKCEIWRMEGGSGHTVTDDIDHFF

SAPSITYREPHLSIYDVLEVQKEELDLSKDLMVLPNAPNRVFAWETGWTPGLRSLENDGTKLLDRIRD

NYEGEFYWRYFAFIADALITTLKPRYEDTNIRINLDSNTRSFIVPIITTEYIREKLSYSFYGSGGTYALSLS

QYNMGINIELSESDVWIIDVDNVVRDVTIESDKIKKGDLIEGILSTLSIEENKIILNSHEINFSGEVNGSNG

FVSLTFSILEGINAIIEVDLLSKSYKLLISGELKILMLNSNHIQQKIDYIGFNSELQKNIPYSFVDSEGKENG

FINGSTKEGLFVSELPDVVLISKVYMDDSKPSFGYYSNNLKDVKVITKDNVNILTGYYLKDDIKISLSLTL

QDEKTIKLNSVHLDESGVAEILKFMNRKGNTNTSDSLMSFLESMNIKSIFVNFLQSNIKFILDANFIISGT

TSIGQFEFICDENDNIQPYFIKFNTLETNYTLYVGNRQNMIVEPNYDLDDSGDISSTVINFSQKYLYGID

SCVNKVVISPNIYTDEINITPVYETNNTYPEVIVLDANYINEKINVNINDLSIRYVWSNDGNDFILMSTSEE

NKVSQVKIRFVNVFKDKTLANKLSFNFSDKQDVPVSEIILSFTPSYYEDGLIGYDLGLVSLYNEKFYINN

FGMMVSGLIYINDSLYYFKPPVNNLITGFVTVGDDKYYFNPINGGAASIGETIIDDKNYYFNQSGVLQT

GVFSTEDGFKYFAPANTLDENLEGEAIDFTGKLIIDENIYYFDDNYRGAVEWKELDGEMHYFSPETGK

AFKGLNQIGDYKYYFNSDGVMQKGFVSINDNKHYFDDSGVMKVGYTEIDGKHFYFAENGEMQIGVF

NTEDGFKYFAHHNEDLGNEEGEEISYSGILNFNNKIYYFDDSFTAVVGWKDLEDGSKYYFDEDTAEA

YIGLSLINDGQYYFNDDGIMQVGFVTINDKVFYFSDSGIIESGVQNIDDNYFYIDDNGIVQIGVFDTSDG

YKYFAPANTVNDNIYGQAVEYSGLVRVGEDVYYFGETYTIETGWIYDMENESDKYYFNPETKKACKGI

NLIDDIKYYFDEKGIMRTGLISFENNNYYFNENGEMQFGYINIEDKMFYFGEDGVMQIGVFNTPDGFKY

FAHQNTLDENFEGESINYTGWLDLDEKRYYFTDEYIAATGSVIIDGEEYYFDPDTAQLVISE

Toxin B-derived recombinant antigen - His-[linear spacer]-
Thioredoxin-[thrombin site]-TxB4
                                                                                    SEQ ID 48
HHHHHHHHHHGGSGGSGGSGGSGGSGGSGGSGGSGGSGGSHMASDKIIHLTDDSFDTDVLKADG

AILVDFWAEWCGPCKMIAPILDEIADEYQGKLTVAKLNIDQNPGTAPKYGIRGIPTLLLFKNGEVAATKV

GALSKGQLKEFLDANLARALVPRGSVTSLYKKAGSAAAPFTMSIIKDISSKEYISFNPKENKITVKSKNL

PELSTLLQEIRNNSNSSDIELEEKVMLTECEINVISNIDTQIVEERIEEAKNLTSDSINYIKDEFKLIESISD

ALCDLKQQNELEDSHFISFEDISETDEGFSIRFINKETGESIFVETEKTIFSEYANHITEEISKIKGTIFDTV

NGKLVKKVNLDTTHEVNTLNAAFFIQSLIEYNSSKESLSNLSVAMKVQVYAQLFSTGLNTITDAAKVVE

LVSTALDETIDLLPTLSEGLPIIATIIDGVSLGAAIKELSETSDPLLRQEIEAKIGIMAVNLTTATTAIITSSLG

IASGFSILLVPLAGISAGIPSLVNNELVLRDKATKVVDYFKHVSLVETEGVFTLLDDKIMMPQDDLVISEI

DFNNNSIVLGKCEIWRMEGGSGHTVTDDIDHFFSAPSITYREPHLSIYDVLEVQKEELDLSKDLMVLPN

APNRVFAWETGWTPGLRSLENDGTKLLDRIRDNYEGEFYWRYFAFIADALITTLKPRYEDTNIRINLDS

NTRSFIVPIITTEYIREKLSYSFYGSGGTYALSLSQYNMGINIELSESDVWIIDVDNVVRDVTIESDKIKKG

DLIEGILSTLSIEENKIILNSHEINFSGEVNGSNGFVSLTFSILEGINAIIEVDLLSKSYKLLISGELKILMLNS

NHIQQKIDYIGFNSELQKNIPYSFVDSEGKENGFINGSTKEGLFVSELPDVVLISKVYMDDSKPSFGYY
```

-continued

```
SNNLKDVKVITKDNVNILTGYYLKDDIKISLSLTLQDEKTIKLNSVHLDESGVAEILKFMNRKGNTNTSD

SLMSFLESMNIKSIFVNFLQSNIKFILDANFIISGTTSIGQFEFICDENDNIQPYFIKFNTLETNYTLYVGNR

QNMIVEPNYDLDDSGDISSTVINFSQKYLYGIDSCVNKVVISPNIYTDEINITPVYETNNTYPEVIVLDAN

YINEKINVNINDLSIRYVWSNDGNDFILMSTSEENKVSQVKIRFVNVFKDKTLANKLSFNFSDKQDVPV

SEIILSFTPSYYEDGLIGYDLGLVSLYNEKFYINNFGMMVSGLIYINDSLYYFKPPVNNLITGFVTVGDDK

YYFNPINGGAASIGETIIDDKNYYFNQSGVLQTGVFSTEDGFKYFAPANTLDENLEGEAIDFTGKLIIDE

NIYYFDDNYRGAVEWKELDGEMHYFSPETGKAFKGLNQIGDYKYYFNSDGVMQKGFVSINDNKHYF

DDSGVMKVGYTEIDGKHFYFAENGEMQIGVFNTEDGFKYFAHHNEDLGNEEGEEISYSGILNFNNKIY

YFDDSFTAVVGWKDLEDGSKYYFDEDTAEAYIGLSLINDGQYYFNDDGIMQVGFVTINDKVFYFSDSG

IIESGVQNIDDNYFYIDDNGIVQIGVFDTSDGYKYFAPANTVNDNIYGQAVEYSGLRVGEDVYYFGET

YTIETGWIYDMENESDKYYFNPETKKACKGINLIDDIKYYFDEKGIMRTGLISFENNNYYFNENGEMQF

GYINIEDKMFYFGEDGVMQIGVFNTPDGFKYFAHQNTLDENFEGESINYTGWLDLDEKRYYFTDEYIA

ATGSVIIDGEEYYFDPDTAQLVISE
```

Toxin B-derived recombinant antigen - His-Thioredoxin-
[linear spacer] -[thrombin site]-TxB4

SEQ ID 49

```
HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALGGSGGSGGSGGSGG

SGGSGGSGGSGGSLVPRGSGSAAAPFTMSIIKDISSKEYISFNPKENKITVKSKNLPELSTLLQEIRNN

SNSSDIELEEKVMLTECEINVISNIDTQIVEERIEEAKNLTSDSINYIKDEFKLIESISDALCDLKQQNELE

DSHFISFEDISETDEGFSIRFINKETGESIFVETEKTIFSEYANHITEEISKIKGTIFDTVNGKLVKKVNLDT

THEVNTLNAAFFIQSLIEYNSSKESLSNLSVAMKVQVYAQLFSTGLNTITDAAKVVELVSTALDETIDLL

PTLSEGLPIIATIIDGVSLGAAIKELSETSDPLLRQEIEAKIGIMAVNLTTATTAIITSSLGIASGFSILLVPLA

GISAGIPSLVNNELVLRDKATKVVDYFKHVSLVETEGVFTLLDDKIMMPQDDLVISEIDFNNNSIVLGKC

EIWRMEGGSGHTVTDDIDHFFSAPSITYREPHLSIYDVLEVQKEELDLSKDLMVLPNAPNRVFAWETG

WTPGLRSLENDGTKLLDRIRDNYEGEFYWRYFAFIADALITTLKPRYEDTNIRINLDSNTRSFIVPIITTE

YIREKLSYSFYGSGGTYALSLSQYNMGINIELSESDVWIIDVDNVVRDVTIESDKIKKGDLIEGILSTLSIE

ENKIILNSHEINFSGEVNGSNGFVSLTFSILEGINAIIEVDLLSKSYKLLISGELKILMLNSNHIQQKIDYIGF

NSELQKNIPYSFVDSEGKENGFINGSTKEGLFVSELPDVVLISKVYMDDSKPSFGYYSNNLKDVKVITK

DNVNILTGYYLKDDIKISLSLTLQDEKTIKLNSVHLDESGVAEILKFMNRKGNTNTSDSLMSFLESMNIK

SIFVNFLQSNIKFILDANFIISGTTSIGQFEFICDENDNIQPYFIKFNTLETNYTLYVGNRQNMIVEPNYDL

DDSGDISSTVINFSQKYLYGIDSCVNKVVISPNIYTDEINITPVYETNNTYPEVIVLDANYINEKINVNINDL

SIRYVWSNDGNDFILMSTSEENKVSQVKIRFVNVFKDKTLANKLSFNFSDKQDVPVSEIILSFTPSYYE

DGLIGYDLGLVSLYNEKFYINNFGMMVSGLIYINDSLYYFKPPVNNLITGFVTVGDDKYYFNPINGGAA

SIGETIIDDKNYYFNQSGVLQTGVFSTEDGFKYFAPANTLDENLEGEAIDFTGKLIIDENIYYFDDNYRG

AVEWKELDGEMHYFSPETGKAFKGLNQIGDYKYYFNSDGVMQKGFVSINDNKHYFDDSGVMKVGY

TEIDGKHFYFAENGEMQIGVFNTEDGFKYFAHHNEDLGNEEGEEISYSGILNFNNKIYYFDDSFTAVV

GWKDLEDGSKYYFDEDTAEAYIGLSLINDGQYYFNDDGIMQVGFVTINDKVFYFSDSGIIESGVQNIDD

NYFYIDDNGIVQIGVFDTSDGYKYFAPANTVNDNIYGQAVEYSGLRVGEDVYYFGETYTIETGWIYD

MENESDKYYFNPETKKACKGINLIDDIKYYFDEKGIMRTGLISFENNNYYFNENGEMQFGYINIEDKMF

YFGEDGVMQIGVFNTPDGFKYFAHQNTLDENFEGESINYTGWLDLDEKRYYFTDEYIAATGSVIIDGE

EYYFDPDTAQLVISE
```

Toxin B-derived recombinant antigen - His-[helical spacer]-
Thioredoxin-[thrombin site]-TxB4

SEQ ID 50

HHHHHHHHHHGGSLAEAAAKEAAAKEAAAKEAAAKAAAGGSHMASDKIIHLTDDSFDTDVLK

ADGAILVDFWAEWCGPCKMIAPILDEIADEYQGKLTVAKLNIDQNPGTAPKYGIRGIPTLLLFKNGEVA

ATKVGALSKGQLKEFLDANLARALVPRGSVTSLYKKAGSAAAPFTMSIIKDISSKEYISFNPKENKITVK

SKNLPELSTLLQEIRNNSNSSDIELEEKVMLTECEINVISNIDTQIVEERIEEAKNLTSDSINYIKDEFKLIE

SISDALCDLKQQNELEDSHFISFEDISETDEGFSIRFINKETGESIFVETEKTIFSEYANHITEEISKIKGTI

FDTVNGKLVKKVNLDTTHEVNTLNAAFFIQSLIEYNSSKESLSNLSVAMKVQVYAQLFSTGLNTITDAA

KVVELVSTALDETIDLLPTLSEGLPIIATIIDGVSLGAAIKELSETSDPLLRQEIEAKIGIMAVNLTTATTAIIT

SSLGIASGFSILLVPLAGISAGIPSLVNNELVLRDKATKVVDYFKHVSLVETEGVFTLLDDKIMMPQDDL

VISEIDFNNNSIVLGKCEIWRMEGGSGHTVTDDIDHFFSAPSITYREPHLSIYDVLEVQKEELDLSKDLM

VLPNAPNRVFAWETGWTPGLRSLENDGTKLLDRIRDNYEGEFYWRYFAFIADALITTLKPRYEDTNIRI

NLDSNTRSFIVPIITTEYIREKLSYSFYGSGGTYALSLSQYNMGINIELSESDVWIIDVDNVVRDVTIESD

KIKKGDLIEGILSTLSIEENKIILNSHEINFSGEVNGSNGFVSLTFSILEGINAIIEVDLLSKSYKLLISGELKI

LMLNSNHIQQKIDYIGFNSELQKNIPYSFVDSEGKENGFINGSTKEGLFVSELPDVVLISKVYMDDSKP

SFGYYSNNLKDVKVITKDNVNILTGYYLKDDIKISLSLTLQDEKTIKLNSVHLDESGVAEILKFMNRKGN

TNTSDSLMSFLESMNIKSIFVNFLQSNIKFILDANFIISGTTSIGQFEFICDENDNIQPYFIKFNTLETNYTL

YVGNRQNMIVEPNYDLDDSGDISSTVINFSQKYLYGIDSCVNKVVISPNIYTDEINITPVYETNNTYPEVI

VLDANYINEKINVNINDLSIRYVWSNDGNDFILMSTSEENKVSQVKIRFVNVFKDKTLANKLSFNFSDK

QDVPVSEIILSFTPSYYEDGLIGYDLGLVSLYNEKFYINNFGMMVSGLIYINDSLYYFKPPVNNLITGFVT

VGDDKYYFNPINGGAASIGETIIDDKNYYFNQSGVLQTGVFSTEDGFKYFAPANTLDENLEGEAIDFTG

KLIIDENIYYFDDNYRGAVEWKELDGEMHYFSPETGKAFKGLNQIGDYKYYFNSDGVMQKGFVSIND

NKHYFDDSGVMKVGYTEIDGKHFYFAENGEMQIGVFNTEDGFKYFAHHNEDLGNEEGEEISYSGILN

FNNKIYYFDDSFTAVVGWKDLEDGSKYYFDEDTAEAYIGLSLINDGQYYFNDDGIMQVGFVTINDKVF

YFSDSGIIESGVQNIDDNYFYIDDNGIVQIGVFDTSDGYKYFAPANTVNDNIYGQAVEYSGLVRVGEDV

YYFGETYTIETGWIYDMENESDKYYFNPETKKACKGINLIDDIKYYFDEKGIMRTGLISFENNNYYFNE

NGEMQFGYINIEDKMFYFGEDGVMQIGVFNTPDGFKYFAHQNTLDENFEGESINYTGWLDLDEKRYY

FTDEYIAATGSVIIDGEEYYFDPDTAQLVISE

Toxin B-derived recombinant antigen - His-Thioredoxin-
[Helical spacer]-[thrombin site]-TxB4

SEQ ID 51

HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALLAEAAAKEAAAKEAAA

KEAAAKEAAAKAAAGGSLVPRGSGSAAAPFTMSIIKDISSKEYISFNPKENKITVKSKNLPELSTLLQEI

RNNSNSSDIELEEKVMLTECEINVISNIDTQIVEERIEEAKNLTSDSINYIKDEFKLIESISDALCDLKQQN

ELEDSHFISFEDISETDEGFSIRFINKETGESIFVETEKTIFSEYANHITEEISKIKGTIFDTVNGKLVKKVN

LDTTHEVNTLNAAFFIQSLIEYNSSKESLSNLSVAMKVQVYAQLFSTGLNTITDAAKVVELVSTALDETI

DLLPTLSEGLPIIATIIDGVSLGAAIKELSETSDPLLRQEIEAKIGIMAVNLTTATTAIITSSLGIASGFSILLV

PLAGISAGIPSLVNNELVLRDKATKVVDYFKHVSLVETEGVFTLLDDKIMMPQDDLVISEIDFNNNSIVL

GKCEIWRMEGGSGHTVTDDIDHFFSAPSITYREPHLSIYDVLEVQKEELDLSKDLMVLPNAPNRVFAW

ETGWTPGLRSLENDGTKLLDRIRDNYEGEFYWRYFAFIADALITTLKPRYEDTNIRINLDSNTRSFIVPII

TTEYIREKLSYSFYGSGGTYALSLSQYNMGINIELSESDVWIIDVDNVVRDVTIESDKIKKGDLIEGILST

-continued

LSIEENKIILNSHEINFSGEVNGSNGFVSLTFSILEGINAIIEVDLLSKSYKLLISGELKILMLNSNHIQQKID

YIGFNSELQKNIPYSFVDSEGKENGFINGSTKEGLFVSELPDVVLISKVYMDDSKPSFGYYSNNLKDVK

VITKDNVNILTGYYLKDDIKISLSLTLQDEKTIKLNSVHLDESGVAEILKFMNRKGNTNTSDSLMSFLES

MNIKSIFVNFLQSNIKFILDANFIISGTTSIGQFEFICDENDNIQPYFIKFNTLETNYTLYVGNRQNMIVEP

NYDLDDSGDISSTVINFSQKYLYGIDSCVNKVVISPNIYTDEINITPVYETNNTYPEVIVLDANYINEKINV

NINDLSIRYVWSNDGNDFILMSTSEENKVSQVKIRFVNVFKDKTLANKLSFNFSDKQDVPVSEIILSFTP

SYYEDGLIGYDLGLVSLYNEKFYINNFGMMVSGLIYINDSLYYFKPPVNNLITGFVTVGDDKYYFNPING

GAASIGETIIDDKNYYFNQSGVLQTGVFSTEDGFKYFAPANTLDENLEGEAIDFTGKLIIDENIYYFDDN

YRGAVEWKELDGEMHYFSPETGKAFKGLNQIGDYKYYFNSDGVMQKGFVSINDNKHYFDDSGVMK

VGYTEIDGKHFYFAENGEMQIGVFNTEDGFKYFAHHNEDLGNEEGEEISYSGILNFNNKIYYFDDSFT

AVVGWKDLEDGSKYYFDEDTAEAYIGLSLINDGQYYFNDDGIMQVGFVTINDKVFYFSDSGIIESGVQ

NIDDNYFYIDDNGIVQIGVFDTSDGYKYFAPANTVNDNIYGQAVEYSGLVRVGEDVYYFGETYTIETG

WIYDMENESDKYYFNPETKKACKGINLIDDIKYYFDEKGIMRTGLISFENNNYYFNENGEMQFGYINIE

DKMFYFGEDGVMQIGVFNTPDGFKYFAHQNTLDENFEGESINYTGWLDLDEKRYYFTDEYIAATGSVI

IDGEEYYFDPDTAQLVISE

Toxin B-derived recombinant antigen - His-[helical spacer]-
Thioredoxin -[thrombin site]-TxB3

SEQ ID 52

HHHHHHHHHHGGSLAEAAAKEAAAKEAAAKEAAAKEAAAKAAAGGSHMASDKIIHLTDDSFDTDVLK

ADGAILVDFWAEWCGPCKMIAPILDEIADEYQGKLTVAKLNIDQNPGTAPKYGIRGIPTLLLFKNGEVA

ATKVGALSKGQLKEFLDANLARALVPRGSVTSLYKKAGSAAGGSMPQDDLVISEIDFNNNSIVLGKCEI

WRMEGGSGHTVTDDIDHFFSAPSITYREPHLSIYDVLEVQKEELDLSKDLMVLPNAPNRVFAWETGW

TPGLRSLENDGTKLLDRIRDNYEGEFYVVRYFAFIADALITTLKPRYEDTNIRINLDSNTRSFIVPIITTEYI

REKLSYSFYGSGGTYALSLSQYNMGINIELSESDVWIIDVDNVVRDVTIESDKIKKGDLIEGILSTLSIEE

NKIILNSHEINFSGEVNGSNGFVSLTFSILEGINAIIEVDLLSKSYKLLISGELKILMLNSNHIQQKIDYIGFN

SELQKNIPYSFVDSEGKENGFINGSTKEGLFVSELPDVVLISKVYMDDSKPSFGYYSNNLKDVKVITKD

NVNILTGYYLKDDIKISLSLTLQDEKTIKLNSVHLDESGVAEILKFMNRKGNTNTSDSLMSFLESMNIKSI

FVNFLQSNIKFILDANFIISGTTSIGQFEFICDENDNIQPYFIKFNTLETNYTLYVGNRQNMIVEPNYDLD

DSGDISSTVINFSQKYLYGIDSCVNKVVISPNIYTDEINITPVYETNNTYPEVIVLDANYINEKINVNINDLS

IRYVWSNDGNDFILMSTSEENKVSQVKIRFVNVFKDKTLANKLSFNFSDKQDVPVSEIILSFTPSYYED

GLIGYDLGLVSLYNEKFYINNFGMMVSGLIYINDSLYYFKPPVNNLITGFVTVGDDKYYFNPINGGAASI

GETIIDDKNYYFNQSGVLQTGVFSTEDGFKYFAPANTLDENLEGEAIDFTGKLIIDENIYYFDDNYRGAV

EWKELDGEMHYFSPETGKAFKGLNQIGDYKYYFNSDGVMQKGFVSINDNKHYFDDSGVMKVGYTEI

DGKHFYFAENGEMQIGVFNTEDGFKYFAHHNEDLGNEEGEEISYSGILNFNNKIYYFDDSFTAVVGW

KDLEDGSKYYFDEDTAEAYIGLSLINDGQYYFNDDGIMQVGFVTINDKVFYFSDSGIIESGVQNIDDNY

FYIDDNGIVQIGVFDTSDGYKYFAPANTVNDNIYGQAVEYSGLVRVGEDVYYFGETYTIETGWIYDME

NESDKYYFNPETKKACKGINLIDDIKYYFDEKGIMRTGLISFENNNYYFNENGEMQFGYINIEDKMFYF

GEDGVMQIGVFNTPDGFKYFAHQNTLDENFEGESINYTGWLDLDEKRYYFTDEYIAATGSVIIDGEEY

YFDPDTAQLVISE

Toxin B-derived recombinant antigen - His-Thioredoxin-
[helical spacer]- [thrombin site]-TxB3

SEQ ID 53

HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALLAEAAAKEAAAKEAAA

-continued

KEAAAKEAAAKAAAGGSLVPRGSGSAAGGSMPQDDLVISEIDFNNNSIVLGKCEIWRMEGGSGHTVT

DDIDHFFSAPSITYREPHLSIYDVLEVQKEELDLSKDLMVLPNAPNRVFAWETGWTPGLRSLENDGTK

LLDRIRDNYEGEFYWRYFAFIADALITTLKPRYEDTNIRINLDSNTRSFIVPIITTEYIREKLSYSFYGSGG

TYALSLSQYNMGINIELSESDVWIIDVDNVVRDVTIESDKIKKGDLIEGILSTLSIEENKIILNSHEINFSGE

VNGSNGFVSLTFSILEGINAIIEVDLLSKSYKLLISGELKILMLNSNHIQQKIDYIGFNSELQKNIPYSFVDS

EGKENGFINGSTKEGLFVSELPDVVLISKVYMDDSKPSFGYYSNNLKDVKVITKDNVNILTGYYLKDDI

KISLSLTLQDEKTIKLNSVHLDESGVAEILKFMNRKGNTNTSDSLMSFLESMNIKSIFVNFLQSNIKFILD

ANFIISGTTSIGQFEFICDENDNIQPYFIKFNTLETNYTLYVGNRQNMIVEPNYDLDDSGDISSTVINFSQ

KYLYGIDSCVNKVVISPNIYTDEINITPVYETNNTYPEVIVLDANYINEKINVNINDLSIRYVWSNDGNDFI

LMSTSEENKVSQVKIRFVNVFKDKTLANKLSFNFSDKQDVPVSEIILSFTPSYYEDGLIGYDLGLVSLYN

EKFYINNFGMMVSGLIYINDSLYYFKPPVNNLITGFVTVGDDKYYFNPINGGAASIGETIIDDKNYYFNQ

SGVLQTGVFSTEDGFKYFAPANTLDENLEGEAIDFTGKLIIDENIYYFDDNYRGAVEWKELDGEMHYF

SPETGKAFKGLNQIGDYKYYFNSDGVMQKGFVSINDNKHYFDDSGVMKVGYTEIDGKHFYFAENGE

MQIGVFNTEDGFKYFAHHNEDLGNEEGEEISYSGILNFNNKIYYFDDSFTAVVGWKDLEDGSKYYFDE

DTAEAYIGLSLINDGQYYFNDDGIMQVGFVTINDKVFYFSDSGIIESGVQNIDDNYFYIDDNGIVQIGVF

DTSDGYKYFAPANTVNDNIYGQAVEYSGLVRVGEDVYYFGETYTIETGWIYDMENESDKYYFNPETK

KACKGINLIDDIKYYFDEKGIMRTGLISFENNNYYFNENGEMQFGYINIEDKMFYFGEDGVMQIGVFNT

PDGFKYFAHQNTLDENFEGESINYTGWLDLDEKRYYFTDEYIAATGSVIIDGEEYYFDPDTAQLVISE

Toxin B-derived recombinant antigen - His-[linear spacer]-
Thioredoxin-[thrombin site]-TxB3
SEQ ID 54

HHHHHHHHHHGGSGGSGGSGGSGGSGGSGGSGSGGSGGSHMASDKIIHLTDDSFDTDVLKADGA

ILVDFWAEWCGPCKMIAPILDEIADEYQGKLTVAKLNIDQNPGTAPKYGIRGIPTLLLFKNGEVAATKVG

ALSKGQLKEFLDANLARALVPRGSVTSLYKKAGSAAGGSMPQDDLVISEIDFNNNSIVLGKCEIWRME

GGSGHTVTDDIDHFFSAPSITYREPHLSIYDVLEVQKEELDLSKDLMVLPNAPNRVFAWETGWTPGLR

SLENDGTKLLDRIRDNYEGEFYWRYFAFIADALITTLKPRYEDTNIRINLDSNTRSFIVPIITTEYIREKLS

YSFYGSGGTYALSLSQYNMGINIELSESDVWIIDVDNVVRDVTIESDKIKKGDLIEGILSTLSIEENKIILN

SHEINFSGEVNGSNGFVSLTFSILEGINAIIEVDLLSKSYKLLISGELKILMLNSNHIQQKIDYIGFNSELQ

KNIPYSFVDSEGKENGFINGSTKEGLFVSELPDVVLISKVYMDDSKPSFGYYSNNLKDVKVITKDNVNI

LTGYYLKDDIKISLSLTLQDEKTIKLNSVHLDESGVAEILKFMNRKGNTNTSDSLMSFLESMNIKSIFVNF

LQSNIKFILDANFIISGTTSIGQFEFICDENDNIQPYFIKFNTLETNYTLYVGNRQNMIVEPNYDLDDSGDI

SSTVINFSQKYLYGIDSCVNKVVISPNIYTDEINITPVYETNNTYPEVIVLDANYINEKINVNINDLSIRYV

WSNDGNDFILMSTSEENKVSQVKIRFVNVFKDKTLANKLSFNFSDKQDVPVSEIILSFTPSYYEDGLIG

YDLGLVSLYNEKFYINNFGMMVSGLIYINDSLYYFKPPVNNLITGFVTVGDDKYYFNPINGGAASIGETII

DDKNYYFNQSGVLQTGVFSTEDGFKYFAPANTLDENLEGEAIDFTGKLIIDENIYYFDDNYRGAVEWK

ELDGEMHYFSPETGKAFKGLNQIGDYKYYFNSDGVMQKGFVSINDNKHYFDDSGVMKVGYTEIDGK

HFYFAENGEMQIGVFNTEDGFKYFAHHNEDLGNEEGEEISYSGILNFNNKIYYFDDSFTAVVGWKDLE

DGSKYYFDEDTAEAYIGLSLINDGQYYFNDDGIMQVGFVTINDKVFYFSDSGIIESGVQNIDDNYFYIDD

NGIVQIGVFDTSDGYKYFAPANTVNDNIYGQAVEYSGLVRVGEDVYYFGETYTIETGWIYDMENESDK

YYFNPETKKACKGINLIDDIKYYFDEKGIMRTGLISFENNNYYFNENGEMQFGYINIEDKMFYFGEDGV

MQIGVFNTPDGFKYFAHQNTLDENFEGESINYTGWLDLDEKRYYFTDEYIAATGSVIIDGEEYYFDPD

TAQLVISE

Toxin B-derived recombinant antigen - His-Thioredoxin-
[linear spacer]-[thrombin site]-TxB3

SEQ ID 55

HHHHHHSHMASDKIIHLTDDSFDTDVLKADGAILVDFWAEWCGPCKMIAPILDEIADEYQGKLTVAKL

NIDQNPGTAPKYGIRGIPTLLLFKNGEVAATKVGALSKGQLKEFLDANLARALGGSGGSGGSGGSGG

SGGSGGSGGSGGSLVPRGSGSAAGGSMPQDDLVISEIDFNNNSIVLGKCEIWRMEGGSGHTVTDDI

DHFFSAPSITYREPHLSIYDVLEVQKEELDLSKDLMVLPNAPNRVFAWETGWTPGLRSLENDGTKLLD

RIRDNYEGEFYWRYFAFIADALITTLKPRYEDTNIRINLDSNTRSFIVPIITTEYIREKLSYSFYGSGGTYA

LSLSQYNMGINIELSESDVWIIDVDNVVRDVTIESDKIKKGDLIEGILSTLSIEENKIILNSHEINFSGEVNG

SNGFVSLTFSILEGINAIIEVDLLSKSYKLLISGELKILMLNSNHIQQKIDYIGFNSELQKNIPYSFVDSEGK

ENGFINGSTKEGLFVSELPDVVLISKVYMDDSKPSFGYYSNNLKDVKVITKDNVNILTGYYLKDDIKISL

SLTLQDEKTIKLNSVHLDESGVAEILKFMNRKGNTNTSDSLMSFLESMNIKSIFVNFLQSNIKFILDANFII

SGTTSIGQFEFICDENDNIQPYFIKFNTLETNYTLYVGNRQNMIVEPNYDLDDSGDISSTVINFSQKYLY

GIDSCVNKVVISPNIYTDEINITPVYETNNTYPEVIVLDANYINEKINVNINDLSIRYVWSNDGNDFILMST

SEENKVSQVKIRFVNVFKDKTLANKLSFNFSDKQDVPVSEIILSFTPSYYEDGLIGYDLGLVSLYNEKFY

INNFGMMVSGLIYINDSLYYFKPPVNNLITGFVTVGDDKYYFNPINGGAASIGETIIDDKNYYFNQSGVL

QTGVFSTEDGFKYFAPANTLDENLEGEAIDFTGKLIIDENIYYFDDNYRGAVEWKELDGEMHYFSPET

GKAFKGLNQIGDYKYYFNSDGVMQKGFVSINDNKHYFDDSGVMKVGYTEIDGKHFYFAENGEMQIG

VFNTEDGFKYFAHHNEDLGNEEGEEISYSGILNFNNKIYYFDDSFTAVVGWKDLEDGSKYYFDEDTAE

AYIGLSLINDGQYYFNDDGIMQVGFVTINDKVFYFSDSGIIESGVQNIDDNYFYIDDNGIVQIGVFDTSD

GYKYFAPANTVNDNIYGQAVEYSGLVRVGEDVYYFGETYTIETGWIYDMENESDKYYFNPETKKACK

GINLIDDIKYYFDEKGIMRTGLISFENNNYYFNENGEMQFGYINIEDKMFYFGEDGVMQIGVFNTPDGF

KYFAHQNTLDENFEGESINYTGWLDLDEKRYYFTDEYIAATGSVIIDGEEYYFDPDTAQLVISE

Toxin B-derived recombinant antigen - His-NusA-[Intein A sequence]-TxB4-His

SEQ ID 56

MGSSHHHHHHSHMASNKEILAVVEAVSNEKALPREKIFEALESALATATKKKYEQEIDVRVQIDRKSG

DFDTFRRWLVVDEVTQPTKEITLEAARYEDESLNLGDYVEDQIESVTFDRITTQTAKQVIVQKVREAER

AMVVDQFREHEGEIITGVVKKVNRDNISLDLGNNAEAVILREDMLPRENFRPGDRVRGVLYSVRPEA

RGAQLFVTRSKPEMLIELFRIEVPEIGEEVIEIKAAARDPGSRAKIAVKTNDKRIDPVGACVGMRGARV

QAVSTELGGERIDIVLWDDNPAQFVINAMAPADVASIVVDEDKHTMDIAVEAGNLAQAIGRNGQNVRL

ASQLSGWELNVMTVDDLQAKHQAEAHAAIDTFTKYLDIDEDFATVLVEEGFSTLEELAYVPMKELLEIE

GLDEPTVEALRERAKNALATIAQAQEESLGDNKPADDLLNLEGVDRDLAFKLAARGVCTLEDLAEQGI

DDLADIEGLTDEKAGALIMAARNICWFGDEASGALRTRVKVVKNKALAEGTRIFDPVTGTTHRIEDVVD

GRKPIHVVAAAKDGTLHARPVVSWFDQGTRDVIGLRIAGGAILWATPDHKVLTEYGWRAAGELRKGD

RVAQPRRFDGFGDSAPIPARVQALADALDDKFLHDMLAEELRYSVIREVLPTRRARTFGLEVEELHTL

VAEGVVVHNSSPPFKQAEFGSAAAPFTMSIIKDISSKEYISFNPKENKITVKSKNLPELSTLLQEIRNNS

NSSDIELEEKVMLTECEINVISNIDTQIVEERIEEAKNLTSDSINYIKDEFKLIESISDALCDLKQQNELED

SHFISFEDISETDEGFSIRFINKETGESIFVETEKTIFSEYANHITEEISKIKGTIFDTVNGKLVKKVNLDTT

HEVNTLNAAFFIQSLIEYNSSKESLSNLSVAMKVQVYAQLFSTGLNTITDAAKVVELVSTALDETIDLLP

TLSEGLPIIATIIDGVSLGAAIKELSETSDPLLRQEIEAKIGIMAVNLTTATTAIITSSLGIASGFSILLVPLAG

ISAGIPSLVNNELVLRDKATKVVDYFKHVSLVETEGVFTLLDDKIMMPQDDLVISEIDFNNNSIVLGKCEI

WRMEGGSGHTVTDDIDHFFSAPSITYREPHLSIYDVLEVQKEELDLSKDLMVLPNAPNRVFAWETGW

TPGLRSLENDGTKLLDRIRDNYEGEFYWRYFAFIADALITTLKPRYEDTNIRINLDSNTRSFIVPIITTEYI

-continued

```
REKLSYSFYGSGGTYALSLSQYNMGINIELSESDVWIIDVDNVVRDVTIESDKIKKGDLIEGILSTLSIEE

NKIILNSHEINFSGEVNGSNGFVSLTFSILEGINAIIEVDLLSKSYKLLISGELKILMLNSNHIQQKIDYIGFN

SELQKNIPYSFVDSEGKENGFINGSTKEGLFVSELPDVVLISKVYMDDSKPSFGYYSNNLKDVKVITKD

NVNILTGYYLKDDIKISLSLTLQDEKTIKLNSVHLDESGVAEILKFMNRKGNTNTSDSLMSFLESMNIKSI

FVNFLQSNIKFILDANFIISGTTSIGQFEFICDENDNIQPYFIKFNTLETNYTLYVGNRQNMIVEPNYDLD

DSGDISSTVINFSQKYLYGIDSCVNKVVISPNIYTDEINITPVYETNNTYPEVIVLDANYINEKINVNINDLS

IRYVWSNDGNDFILMSTSEENKVSQVKIRFVNVFKDKTLANKLSFNFSDKQDVPVSEIILSFTPSYYED

GLIGYDLGLVSLYNEKFYINNFGMMVSGLIYINDSLYYFKPPVNNLITGFVTVGDDKYYFNPINGGAASI

GETIIDDKNYYFNQSGVLQTGVFSTEDGFKYFAPANTLDENLEGEAIDFTGKLIIDENIYYFDDNYRGAV

EWKELDGEMHYFSPETGKAFKGLNQIGDYKYYFNSDGVMQKGFVSINDNKHYFDDSGVMKVGYTEI

DGKHFYFAENGEMQIGVFNTEDGFKYFAHHNEDLGNEEGEEISYSGILNFNNKIYYFDDSFTAVVGW

KDLEDGSKYYFDEDTAEAYIGLSLINDGQYYFNDDGIMQVGFVTINDKVFYFSDSGIIESGVQNIDDNY

FYIDDNGIVQIGVFDTSDGYKYFAPANTVNDNIYGQAVEYSGLVRVGEDVYYFGETYTIETGWIYDME

NESDKYYFNPETKKACKGINLIDDIKYYFDEKGIMRTGLISFENNNYYFNENGEMQFGYINIEDKMFYF

GEDGVMQIGVFNTPDGFKYFAHQNTLDENFEGESINYTGWLDLDEKRYYFTDEYIAATGSVIIDGEEY

YFDPDTAQLVISEGHHHHHH

Toxin B-derived recombinant antigen - His-NusA-[Intein BT sequence]-TxB4-His   SEQ ID 57

MGSSHHHHHHSHMASNKEILAVVEAVSNEKALPREKIFEALESALATATKKKYEQEIDVRVQIDRKSG

DFDTFRRWLVVDEVTQPTKEITLEAARYEDESLNLGDYVEDQIESVTFDRITTQTAKQVIVQKVREAER

AMVVDQFREHEGEIITGVVKKVNRDNISLDLGNNAEAVILREDMLPRENFRPGDRVRGVLYSVRPEA

RGAQLFVTRSKPEMLIELFRIEVPEIGEEVIEIKAAARDPGSRAKIAVKTNDKRIDPVGACVGMRGARV

QAVSTELGGERIDIVLWDDNPAQFVINAMAPADVASIVVDEDKHTMDIAVEAGNLAQAIGRNGQNVRL

ASQLSGWELNVMTVDDLQAKHQAEAHAAIDTFTKYLDIDEDFATVLVEEGFSTLEELAYVPMKELLEIE

GLDEPTVEALRERAKNALATIAQAQEESLGDNKPADDLLNLEGVDRDLAFKLAARGVCTLEDLAEQGI

DDLADIEGLTDEKAGALIMAARNICWFGDEASGALEVFGEFGSGKAFARDTEVYYENDTVPHMESIEE

MYSKYASMNGELPFDNGYAVPLDNVFVYTLDIASGEIKKTRASYIYREKVEKLIEIKLSSGYSLKVTPSH

PVLLFRDGLQWVPAAEVKPGDVVVGVREEVLRRRIISKGELEFHEVSSVRIIDYNNWVYDLVIPETHNF

IAPNGLVLHNTQLAHTLAVMGSAAAPFTMSIIKDISSKEYISFNPKENKITVKSKNLPELSTLLQEIRNNS

NSSDIELEEKVMLTECEINVISNIDTQIVEERIEEAKNLTSDSINYIKDEFKLIESISDALCDLKQQNELED

SHFISFEDISETDEGFSIRFINKETGESIFVETEKTIFSEYANHITEEISKIKGTIFDTVNGKLVKKVNLDTT

HEVNTLNAAFFIQSLIEYNSSKESLSNLSVAMKVQVYAQLFSTGLNTITDAAKVVELVSTALDETIDLLP

TLSEGLPIIATIIDGVSLGAAIKELSETSDPLLRQEIEAKIGIMAVNLTTATTAIITSSLGIASGFSILLVPLAG

ISAGIPSLVNNELVLRDKATKVVDYFKHVSLVETEGVFTLLDDKIMMPQDDLVISEIDFNNNSIVLGKCEI

WRMEGGSGHTVTDDIDHFFSAPSITYREPHLSIYDVLEVQKEELDLSKDLMVLPNAPNRVFAWETGW

TPGLRSLENDGTKLLDRIRDNYEGEFYWRYFAFIADALITTLKPRYEDTNIRINLDSNTRSFIVPIITTEYI

REKLSYSFYGSGGTYALSLSQYNMGINIELSESDVWIIDVDNVVRDVTIESDKIKKGDLIEGILSTLSIEE

NKIILNSHEINFSGEVNGSNGFVSLTFSILEGINAIIEVDLLSKSYKLLISGELKILMLNSNHIQQKIDYIGFN

SELQKNIPYSFVDSEGKENGFINGSTKEGLFVSELPDVVLISKVYMDDSKPSFGYYSNNLKDVKVITKD

NVNILTGYYLKDDIKISLSLTLQDEKTIKLNSVHLDESGVAEILKFMNRKGNTNTSDSLMSFLESMNIKSI

FVNFLQSNIKFILDANFIISGTTSIGQFEFICDENDNIQPYFIKFNTLETNYTLYVGNRQNMIVEPNYDLD
```

-continued

DSGDISSTVINFSQKYLYGIDSCVNKVVISPNIYTDEINITPVYETNNTYPEVIVLDANYINEKINVNINDLS

IRYVWSNDGNDFILMSTSEENKVSQVKIRFVNVFKDKTLANKLSFNFSDKQDVPVSEIILSFTPSYYED

GLIGYDLGLVSLYNEKFYINNFGMMVSGLIYINDSLYYFKPPVNNLITGFVTVGDDKYYFNPINGGAASI

GETIIDDKNYYFNQSGVLQTGVFSTEDGFKYFAPANTLDENLEGEAIDFTGKLIIDENIYYFDDNYRGAV

EWKELDGEMHYFSPETGKAFKGLNQIGDYKYYFNSDGVMQKGFVSINDNKHYFDDSGVMKVGYTEI

DGKHFYFAENGEMQIGVFNTEDGFKYFAHHNEDLGNEEGEEISYSGILNFNNKIYYFDDSFTAVVGW

KDLEDGSKYYFDEDTAEAYIGLSLINDGQYYFNDDGIMQVGFVTINDKVFYFSDSGIIESGVQNIDDNY

FYIDDNGIVQIGVFDTSDGYKYFAPANTVNDNIYGQAVEYSGLVRVGEDVYYFGETYTIETGWIYDME

NESDKYYFNPETKKACKGINLIDDIKYYFDEKGIMRTGLISFENNNYYFNENGEMQFGYINIEDKMFYF

GEDGVMQIGVFNTPDGFKYFAHQNTLDENFEGESINYTGWLDLDEKRYYFTDEYIAATGSVIIDGEEY

YFDPDTAQLVISEGHHHHHH

Toxin A-derived recombinant antigen (TxA4; residues 770-2710) expression construct

SEQ ID 58

MGSSHHHHHHSHMASDKIIHLTDDSFDTDVLKADGAILVDFWAEWCGPCKMIAPILDEIADEYQGKLT

VAKLNIDQNPGTAPKYGIRGIPTLLLFKNGEVAATKVGALSKGQLKEFLDANLARALEVLFQGPGGSA

DARAKAQFEEYKRNYFEGAGGSIMSDLSSKEYIFFDSIDNKLKAKSKNIPGLASISEDIKTLLLDASVSP

DTKFILNNLKLNIESSIGDYIYYEKLEPVKNIIHNSIDDLIDEFNLLENVSDELYELKKLNNLDEKYLISFEDI

SKNNSTYSVRFINKSNGESVYVETEKEIFSKYSEHITKEISTIKNSIITDVNGNLLDNIQLDHTSQVNTLN

AAFFIQSLIDYSSNKDVLNDLSTSVKVQLYAQLFSTGLNTIYDSIQLVNLISNAVNDTINVLPTITEGIPIVS

TILDGINLGAAIKELLDEHDPLLKKELEAKVGVLAINMSLSIAATVASIVGIGAEVTIFLLPIAGISAGIPSLV

NNELILHDKATSVVNYFNHLSESKKYGPLKTEDDKILVPIDDLVISEIDFNNNSIKLGTCNILAMEGGSG

HTVTGNIDHFFSSPSISSHIPSLSIYSAIGIETENLDFSKKIMMLPNAPSRVFWWETGAVPGLRSLENDG

TRLLDSIRDLYPGKFYWRFYAFFDYAITTLKPVYEDTNIKIKLDKDTRNFIMPTITTNEIRNKLSYSFDGA

GGTYSLLLSSYPISTNINLSKDDLWIFNIDNEVREISIENGTIKKGKLIKDVLSKIDINKNKLIIGNQTIDFSG

DIDNKDRYIFLTCELDDKISLIIEINLVAKSYSLLLSGDKNYLISNLSNIIEKINTLGLDSKNIAYNYTDESNN

KYFGAISKTSQKSIIHYKKDSKNILEFYNDSTLEFNSKDFIAEDINVFMKDDINTITGKYYVDNNTDKSIDF

SISLVSKNQVKVNGLYLNESVYSSYLDFVKNSDGHHNTSNFMNLFLDNISFWKLFGFENINFVIDKYFT

LVGKTNLGYVEFICDNNKNIDIYFGEWKTSSSKSTIFSGNGRNVVVEPIYNPDTGEDISTSLDFSYEPLY

GIDRYINKVLIAPDLYTSLININTNYYSNEYYPEIIVLNPNTFHKKVNINLDSSSFEYKWSTEGSDFILVRY

LEESNKKILQKIRIKGILSNTQSFNKMSIDFKDIKKLSLGYIMSNFKSFNSENELDRDHLGFKIIDNKTYYY

DEDSKLVKGLININNSLFYFDPIEFNLVTGWQTINGKKYYFDINTGAALISYKIINGKHFYFNNDGVMQL

GVFKGPDGFEYFAPANTQNNNIEGQAIVYQSKFLTLNGKKYYFDNDSKAVTGWRIINNEKYYFNPNN

AIAAVGLQVIDNNKYYFNPDTAIISKGWQTVNGSRYYFDTDTAIAFNGYKTIDGKHFYFDSDCVVKIGV

FSTSNGFEYFAPANTYNNNIEGQAIVYQSKFLTLNGKKYYFDNNSKAVTGWTIDSKKYYFNTNTAEA

ATGWQTIDGKKYYFNTNTAEAATGWQTIDGKKYYFNTNTAIASTGYTIINGKHFYFNTDGIMQIGVFKG

PNGFEYFAPANTDANNIEGQAILYQNEFLTLNGKKYYFGSDSKAVTGWRIINNKKYYFNPNNAIAAIHL

CTINNDKYYFSYDGILQNGYITIERNNFYFDANNESKMVTGVFKGPNGFEYFAPANTHNNNIEGQAIVY

QNKFLTLNGKKYYFDNDSKAVTGWQTIDGKKYYFNLNTAEAATGWQTIDGKKYYFNLNTAEAATGW

QTIDGKKYYFNTNTFIASTGYTSINGKHFYFNTDGIMQIGVFKGPNGFEYFAPANTHNNNIEGQAILYQ

NKFLTLNGKKYYFGSDSKAVTGLRTIDGKKYYFNTNTAVAVTGWQTINGKKYYFNTNTSIASTGYTIIS

GKHFYFNTDGIMQIGVFKGPDGFEYFAPANTDANNIEGQAIRYQNRFLYLHDNIYYFGNNSKAATGW

-continued

VTIDGNRYYFEPNTAMGANGYKTIDNKNFYFRNGLPQIGVFKGSNGFEYFAPANTDANNIEGQAIRYQ

NRFLHLLGKIYYFGNNSKAVTGWQTINGKVYYFMPDTAMAAAGGLFEIDGVIYFFGVDGVKAPGIYG

Toxin A-derived recombinant antigen (TxA4 truncate;
residues 770-2389) expression construct

SEQ ID 59

MGSSHHHHHHSHMASDKIIHLTDDSFDTDVLKADGAILVDFWAEWCGPCKMIAPILDEIADEYQGKLT

VAKLNIDQNPGTAPKYGIRGIPTLLLFKNGEVAATKVGALSKGQLKEFLDANLARALVPRGSGGSADA

RAKAQFEEYKRNYFEGAGGSAAAPFTMIMSDLSSKEYIFFDSIDNKLKAKSKNIPGLASISEDIKTLLLD

ASVSPDTKFILNNLKLNIESSIGDYIYYEKLEPVKNIIHNSIDDLIDEFNLLENVSDELYELKKLNNLDEKYL

ISFEDISKNNSTYSVRFINKSNGESVYVETEKEIFSKYSEHITKEISTIKNSIITDVNGNLLDNIQLDHTSQ

VNTLNAAFFIQSLIDYSSNKDVLNDLSTSVKVQLYAQLFSTGLNTIYDSIQLVNLISNAVNDTINVLPTITE

GIPIVSTILDGINLGAAIKELLDEHDPLLKKELEAKVGVLAINMSLSIAATVASIVGIGAEVTIFLLPIAGISA

GIPSLVNNELILHDKATSVVNYFNHLSESKKYGPLKTEDDKILVPIDDLVISEIDFNNNSIKLGTCNILAME

GGSGHTVTGNIDHFFSSPSISSHIPSLSIYSAIGIETENLDFSKKIMMLPNAPSRVFWWETGAVPGLRS

LENDGTRLLDSIRDLYPGKFYWRFYAFFDYAITTLKPVYEDTNIKIKLDKDTRNFIMPTITTNEIRNKLSY

SFDGAGGTYSLLLSSYPISTNINLSKDDLWIFNIDNEVREISIENGTIKKGKLIKDVLSKIDINKNKLIIGNQ

TIDFSGDIDNKDRYIFLTCELDDKISLIIEINLVAKSYSLLLSGDKNYLISNLSNIIEKINTLGLDSKNIAYNYT

DESNNKYFGAISKTSQKSIIHYKKDSKNILEFYNDSTLEFNSKDFIAEDINVFMKDDINTITGKYYVDNNT

DKSIDFSISLVSKNQVKVNGLYLNESVYSSYLDFVKNSDGHHNTSNFMNLFLDNISFWKLFGFENINFV

IDKYFTLVGKTNLGYVEFICDNNKNIDIYFGEWKTSSSKSTIFSGNGRNVVVEPIYNPDTGEDISTSLDF

SYEPLYGIDRYINKVLIAPDLYTSLININTNYYSNEYYPEIIVLNPNTFHKKVNINLDSSSFEYKWSTEGS

DFILVRYLEESNKKILQKIRIKGILSNTQSFNKMSIDFKDIKKLSLGYIMSNFKSFNSENELDRDHLGFKII

DNKTYYYDEDSKLVKGLININNSLFYFDPIEFNLVTGWQTINGKKYYFDINTGAALISYKIINGKHFYFNN

DGVMQLGVFKGPDGFEYFAPANTQNNNIEGQAIVYQSKFLTLNGKKYYFDNDSKAVTGWRIINNEKY

YFNPNNAIAAVGLQVIDNNKYYFNPDTAIISKGWQTVNGSRYYFDTDTAIAFNGYKTIDGKHFYFDSDC

VVKIGVFSTSNGFEYFAPANTYNNNIEGQAIVYQSKFLTLNGKKYYFDNNSKAVTGWQTIDSKKYYFN

TNTAEAATGWQTIDGKKYYFNTNTAEAATGWQTIDGKKYYFNTNTAIASTGYTIINGKHFYFNTDGIM

QIGVFKGPNGFEYFAPANTDANNIEGQAILYQNEFLTLNGKKYYFGSDSKAVTGWRIINNKKYYFNPN

NAIAAIHLCTINNDKYYFSYDGILQNGYITIERNNFYFDANNESKMVTGVFKGPNGFEYFAPANTHNNNI

EGQAIVYQNKFLTLNGKKYYFDNDSKAVTGWQTIDGKKYYFNLNTAEAATGWQTIDGKKYYFNLNTA

EAATGWQTIDGKKYYFNTNTFIAST

SEQUENCE LISTING (81 sequences)

SEQ ID NO: 1 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 2 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 3 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 4 - protein, 2366 aa, Clostridium difficile
MSLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVDMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 5 - protein, 1580 aa, Clostridium difficile
ESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 6 - protein, 1580 aa, Clostridium difficile
ESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 7 - protein, 1941 aa, Clostridium difficile
IMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 8 - protein, 1941 aa, Clostridium difficile
IMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 9 - protein, 1222 aa, Clostridium difficile
MPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 10 - protein, 1222 aa, Clostridium difficile
MPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 11 - protein, 1410 aa, Clostridium difficile
NTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 12 - protein, 1410 aa, Clostridium difficile
NTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 13 - protein, 1600 aa, Clostridium difficile
SIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 14 - protein, 1600 aa, Clostridium difficile
SIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 15 - protein, 1756 aa, Clostridium difficile
NTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 16 - protein, 1595 aa, Clostridium difficile
IMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 17 - protein, 1595 aa, Clostridium difficile
IMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 18 - protein, 2493 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYGGGSGGSLVPRGSGGSHHHHHH

SEQ ID NO: 19 - protein, 2472 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 20 - protein, 2084 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 21 - protein, 1723 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 22 - protein, 2111 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 23 - protein, 2138 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISEGHHHHHH

SEQ ID NO: 24 - protein, 2131 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 25 - protein, 1743 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 26 - protein, 1751 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAGGSMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 27 - protein, 1363 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAGGSMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 28 - protein, 2504 aa, Artificial Sequence
  Fusion protein
HHHHHHHHHGGSGGSGGSGGSGGSGGSGGSGGSGGSGGSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 29 - protein, 2511 aa, Artificial Sequence
  Fusion protein
HHHHHHHHHHGGSLAEAAAKEAAAKEAAAKEAAAKEAAAKAAAGGSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 30 - protein, 2492 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALGGSGGSGGSGGSGGSGGSGGSGGSGGSLVPRGSGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 31 - protein, 2498 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALLAEAAAKEAAAKEAAAKEAAAKEAAAKAAAGGSLVPRGSGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 32 - protein, 2143 aa, Artificial Sequence
  Fusion protein
HHHHHHHHHGGSGGSGGSGGSGGSGGSGGSGGSGGSGGSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 33 - protein, 2150 aa, Artificial Sequence
  Fusion protein
HHHHHHHHHHGGSLAEAAAKEAAAKEAAAKEAAAKEAAAKAAAGGSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 34 - protein, 2131 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALGGSGGSGGSGGSGGSGGSGGSGGSGGSLVPRGSGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 35 - protein, 2137 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALLAEAAAKEAAAKEAAAKEAAAKEAAAKAAAGGSLVPRGSGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 36 - protein, 2116 aa, Artificial Sequence
  Fusion protein
HHHHHHHHHGGSGGSGGSGGSGGSGGSGGSGGSGGSGGSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 37 - protein, 2123 aa, Artificial Sequence
  Fusion protein
HHHHHHHHHHGGSLAEAAAKEAAAKEAAAKEAAAKEAAAKAAAGGSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 38 - protein, 2104 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALGGSGGSGGSGGSGGSGGSGGSGGSGGSLVPRGSGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 39 - protein, 2110 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALLAEAAAKEAAAKEAAAKEAAAKEAAAKAAAGGSLVPRGSGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 40 - protein, 1755 aa, Artificial Sequence
  Fusion protein
HHHHHHHHHGGSGGSGGSGGSGGSGGSGGSGGSGGSGGSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 41 - protein, 1762 aa, Artificial Sequence
  Fusion protein
HHHHHHHHHHGGSLAEAAAKEAAAKEAAAKEAAAKEAAAKAAAGGSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 42 - protein, 1743 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALGGSGGSGGSGGSGGSGGSGGSGGSGGSLVPRGSGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 43 - protein, 1749 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALLAEAAAKEAAAKEAAAKEAAAKEAAAKAAAGGSLVPRGSGSAAAPFTMESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 44 - protein, 2163 aa, Artificial Sequence
  Fusion protein
HHHHHHHHHGGSGGSGGSGGSGGSGGSGGSGGSGGSGGSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 45 - protein, 2151 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALGGSGGSGGSGGSGGSGGSGGSGGSGGSLVPRGSGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 46 - protein, 2170 aa, Artificial Sequence
  Fusion protein
HHHHHHHHHHGGSLAEAAAKEAAAKEAAAKEAAAKEAAAKAAAGGSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALVPRGSVTSLYKKAGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 47 - protein, 2157 aa, Artificial Sequence
  Fusion protein
HHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALLAEAAAKEAAAKEAAAKEAAAKEAAAKAAAGGSLVPRGSGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 48 - protein, 1776 aa, Artificial Sequence
  Fusion protein
HHHHHHHHHHGGSGGSGGSGGSGGSGGSGGSGGSGGSGGSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 49 - protein, 1763 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALGGSGGSGGSGGSGGSGGSGGSGGSGGSLVPRGSGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 50 - protein, 1782 aa, Artificial Sequence
  Fusion protein
HHHHHHHHHHGGSLAEAAAKEAAAKEAAAKEAAAKEAAAKAAAGGSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 51 - protein, 1769 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALLAEAAAKEAAAKEAAAKEAAAKEAAAKAAAGGSLVPRGSGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 52 - protein, 1402 aa, Artificial Sequence
  Fusion protein
HHHHHHHHHHGGSLAEAAAKEAAAKEAAAKEAAAKEAAAKAAAGGSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAGGSMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 53 - protein, 1389 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALLAEAAAKEAAAKEAAAKEAAAKEAAAKAAAGGSLVPRGSGSAAGGSMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 54 - protein, 1395 aa, Artificial Sequence
  Fusion protein
HHHHHHHHHGGSGGSGGSGGSGGSGGSGGSGGSGGSGGSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSVTSLYKKAGSAAGGSMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 55 - protein, 1383 aa, Artificial Sequence
  Fusion protein
HHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALGGSGGSGGSGGSGGSGGSGGSGGSGGSLVPRGSGSAAGGSMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 56 - protein, 2317 aa, Artificial Sequence
  Fusion protein
MGSSHHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALRTRVKVVKNKALAEGTRIFDPVTGTTHRIEDVVDGRKPIHVVAAAKDGTLHARPVVSWFDQGTRDVIGLRIAGGAILWATPDHKVLTEYGWRAAGELRKGDRVAQPRRFDGFGDSAPIPARVQALADALDDKFLHDMLAEELRYSVIREVLPTRRARTFGLEVEELHTLVAEGVVVHNSSPPFKQAEFGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISEGHHHHHH

SEQ ID NO: 57 - protein, 2321 aa, Artificial Sequence
  Fusion protein
MGSSHHHHHHSHMASNKEILAVVEAVSNEKALPREKIFEALESALATATKKKYEQEIDVRVQIDRKSGDFDTFRRWLVVDEVTQPTKEITLEAARYEDESLNLGDYVEDQIESVTFDRITTQTAKQVIVQKVREAERAMVVDQFREHEGEIITGVVKKVNRDNISLDLGNNAEAVILREDMLPRENFRPGDRVRGVLYSVRPEARGAQLFVTRSKPEMLIELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIEGLDEPTVEALRERAKNALATIAQAQEESLGDNKPADDLLNLEGVDRDLAFKLAARGVCTLEDLAEQGIDDLADIEGLTDEKAGALIMAARNICWFGDEASGALEVFGEFGSGKAFARDTEVYYENDTVPHMESIEEMYSKYASMNGELPFDNGYAVPLDNVFVYTLDIASGEIKKTRASYIYREKVEKLIEIKLSSGYSLKVTPSHPVLLFRDGLQWVPAAEVKPGDVVVGVREEVLRRRIISKGELEFHEVSSVRIIDYNNWVYDLVIPETHNFIAPNGLVLHNTQLAHTLAVMGSAAAPFTMSIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISEGHHHHHH

SEQ ID NO: 58 - protein, 2099 aa, Clostridium difficile
MGSSHHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALEVLFQGPGGSADARAKAQFEEYKRNYFEGAGGSIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 59 - protein, 1783 aa, Clostridium difficile
MGSSHHHHHHSHMASDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLARALVPRGSGGSADARAKAQFEEYKRNYFEGAGGSAAAPFTMIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIAST

SEQ ID NO: 60 - protein, 31 aa, Clostridium difficile
GVFKGPDGFEYFAPANTQNNNIEGQAIVYQS

SEQ ID NO: 61 - protein, 157 aa, Clostridium difficile
VTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFN

SEQ ID NO: 62 - protein, 31 aa, Clostridium difficile
GVFSTSNGFEYFAPANTYNNNIEGQAIVYQS

SEQ ID NO: 63 - protein, 134 aa, Clostridium difficile
GYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIAST

SEQ ID NO: 64 - protein, 31 aa, Clostridium difficile
GVFKGPNGFEYFAPANTDANNIEGQAILYQN

SEQ ID NO: 65 - protein, 112 aa, Clostridium difficile
GYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQN

SEQ ID NO: 66 - protein, 31 aa, Clostridium difficile
GVFKGPNGFEYFAPANTHNNNIEGQAIVYQN

SEQ ID NO: 67 - protein, 136 aa, Clostridium difficile
GYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIAST

SEQ ID NO: 68 - protein, 31 aa, Clostridium difficile; identical to SEQ ID NO: 64

SEQ ID NO: 69 - protein, 113 aa, Clostridium difficile
GYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIAST

SEQ ID NO: 70 - protein, 31 aa, Clostridium difficile
GVFKGPDGFEYFAPANTDANNIEGQAIRYQN

SEQ ID NO: 71 - protein, 92 aa, Clostridium difficile
GYTIISGKHFYFNTDGIMQIGVFKGPDGFEYFAPANTDANNIEGQAIRYQNRFLYLHDNIYYFGNNSKAATGWVTIDGNRYYFEPNTAMGAN

SEQ ID NO: 72 - protein, 31 aa, Clostridium difficile
GVFKGSNGFEYFAPANTDANNIEGQAIRYQN

SEQ ID NO: 73 - protein, 116 aa, Clostridium difficile
GYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 74 - protein, 147 aa, Clostridium difficile
DDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKV

SEQ ID NO: 75 - protein, 147 aa, Clostridium difficile; identical to SEQ ID NO: 74

SEQ ID NO: 76 - protein, 30 aa, Clostridium difficile
GVFNTEDGFKYFAHHNEDLGNEEGEEISYS

SEQ ID NO: 77 - protein, 132 aa, Clostridium difficile
GYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIES

SEQ ID NO: 78 - protein, 30 aa, Clostridium difficile
GVFDTSDGYKYFAPANTVNDNIYGQAVEYS

SEQ ID NO: 79 - protein, 134 aa, Clostridium difficile
GVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQF

SEQ ID NO: 80 - protein, 30 aa, Clostridium difficile
GVFNTPDGFKYFAHQNTLDENFEGESINYT

SEQ ID NO: 81 - protein, 93 aa, Clostridium difficile
GYINIEDKMFYFGEDGVMQIGVFNTPDGFKYFAHQNTLDENFEGESINYTGWLDLDEKRYYFTDEYIAATGSVIIDGEEYYFDPDTAQLVISE

The invention claimed is:

1. A protein, comprising
   a) an amino acid sequence that comprises amino acid residues 767-2366 of a C. difficile Toxin B sequence; or
   b) an amino acid sequence that comprises amino acid residues 1145-2366 of a C. difficile Toxin B sequence; with the proviso that the protein is not a polypeptide comprising amino acid residues 543-2366 of the C. difficile Toxin B;

wherein the protein can elicit a toxin-neutralizing immune response; and wherein said *C. difficile* Toxin B sequences are the *C. difficile* Toxin B amino acid residue sequence 767-2366 or 1145-2366 of SEQ ID NO:2 or the *C. difficile* Toxin B amino acid residue sequence 767-2366 or 1145-2366 of SEQ ID NO:4.

2. The protein according to claim 1, wherein other than the above-defined Toxin B amino acid sequences, said protein does not include any additional Toxin B amino acid sequence.

3. A method of generating an antibody that binds to a *C. difficile* Toxin B, the method comprising:

immunizing an animal with the protein according to claim 1 to induce production of an antibody specific for *C. difficile* Toxin B.

4. The method according to claim 3, further comprising the step of isolating the antibody specific for *C. difficile* Toxin B from the immunized animal.

5. The method according to claim 4, wherein the antibody is isolated by affinity purification.

6. The method according to claim 3, wherein the animal is horse, sheep, goat, or human.

7. A protein, consisting of:

a) amino acid residues 767-2366 of a *C. difficile* Toxin B sequence; or b) amino acid residues 1145-2366 of a *C. difficile* Toxin B sequence;

wherein the protein can elicit a toxin-neutralizing immune response; and wherein said *C. difficile* Toxin B sequences are the *C. difficile* Toxin B amino acid residue sequence 767-2366 or 1145-2366 of SEQ ID NO:2 or the *C. difficile* Toxin B amino acid residue sequence 767-2366 or 1145-2366 of SEQ ID NO:4.

* * * * *